(12) United States Patent
O'Brien et al.

(10) Patent No.: US 8,895,703 B2
(45) Date of Patent: Nov. 25, 2014

(54) CA125 GENE AND ITS USE FOR DIAGNOSTIC AND THERAPEUTIC INTERVENTIONS

(75) Inventors: Timothy O'Brien, Little Rock, AR (US); John Beard, Little Rock, AR (US); Lowell Underwood, Fayetteville, AR (US)

(73) Assignee: The Board of Trustees for the University of Arkansas, Little Rock, AR (US)

(*) Notice: Subject to any disclaimer, the term of this patent is extended or adjusted under 35 U.S.C. 154(b) by 1707 days.

(21) Appl. No.: 11/975,668

(22) Filed: Oct. 19, 2007

(65) Prior Publication Data

US 2009/0035819 A1 Feb. 5, 2009

Related U.S. Application Data

(63) Continuation of application No. 10/475,117, filed on Oct. 17, 2003, now Pat. No. 8,124,728, which is a continuation-in-part of application No. PCT/US02/11734, filed on Apr. 12, 2002, application No. 11/975,668, which is a continuation-in-part of application No. 09/965,738, filed on Sep. 27, 2001, now Pat. No. 7,309,760.

(60) Provisional application No. 60/284,175, filed on Apr. 17, 2001, provisional application No. 60/299,380, filed on Jun. 19, 2001, provisional application No. 60/345,180, filed on Dec. 21, 2001, provisional application No. 60/427,045, filed on Nov. 15, 2002.

(51) Int. Cl.
*C07K 16/00* (2006.01)
*C12P 21/08* (2006.01)
*C07K 14/705* (2006.01)
*C07K 16/30* (2006.01)

(52) U.S. Cl.
CPC ........... *C07K 14/705* (2013.01); *C07K 16/3092* (2013.01)
USPC ............... 530/388.1; 530/388.8; 530/388.85

(58) Field of Classification Search
None
See application file for complete search history.

(56) References Cited

U.S. PATENT DOCUMENTS

| | | | |
|---|---|---|---|
| 4,921,790 A * | 5/1990 | O'Brien | 435/7.94 |
| 6,335,194 B1 | 1/2002 | Bennett et al. | |
| 6,451,602 B1 | 9/2002 | Popoff et al. | |
| 6,468,546 B1 | 10/2002 | Mitcham et al. | |
| 7,064,188 B2 * | 6/2006 | O'Brien | 530/388.8 |
| 2003/0082655 A1 * | 5/2003 | O'Brien | 435/7.23 |
| 2003/0143667 A1 | 7/2003 | O'Brien et al. | |
| 2004/0127401 A1 | 7/2004 | O'Brien et al. | |
| 2007/0015907 A1 | 1/2007 | O'Brien et al. | |

FOREIGN PATENT DOCUMENTS

| | | | | |
|---|---|---|---|---|
| EP | 0288082 A | 10/1988 | | |
| EP | 1 074 617 A2 * | 2/2001 | ............ | C12N 15/12 |
| WO | WO 00/36107 A | 6/2000 | | |
| WO | WO 00/58473 | * 10/2000 | ............ | C12N 15/12 |
| WO | WO 02/06317 | * 1/2002 | ............ | C07K 14/00 |
| WO | WO 02/092836 A | 11/2002 | | |

OTHER PUBLICATIONS

Harlow et al. (Antibodies, A Laboratory Manual, Chapter 5, p. 76, 1988).*
Harlow and Lane (Antibodies, a Laboratory Manual, Cold Spring Harbor Laboratory Press, 1988, p. 141-142).*
Bon GC et al. Am. J. Obstet. Gynecol. 174:107-114, 1996.
Clemons-Miller A et al. Clincal Cancer Research 7:917s-924s, Mar. 2001 (Suppl.).
Fendrick JL et al. Tumor Biol. 14:310-318, 1993.
Fendrick JL et al. Tmuor Biol. 18:278-289, 1997.
Foon KA et al., Clin. Cancer Research 7:1112-1115, 2001.
Gendler SJ et al., Annu. Rev. Physiol. 57:607-634, 1995.
Gum Jr., JR Am. J. Respir Cell Mol. Biol. 7:557-564, 1992.
Gum JR. Biochemical Society Transactions 23:795-599, 1995.
Hardardottir H et al., Am. J. Obstet. Gynecol. 163:1925-1931, 1990.
Konish I et al., J. Soc. Gynecol. Invest. 1:89-96, 1994.
O'Brien TJ et al., More than 15 years of CA125: what is known about the antigen, its structure and its function. International J. of Biological Markers 13:188-195, 1998.
Lloyd KO et al. Isolation and characterization of ovarian cancer antigen CA125 using a new . . . International J. Cancer 71:842-850, 1997.
Nap M et al. Immunohistochemical characterization of 22 monoclonal antibodies . . . Tumor Biol.: 17:325-331, 1996.
Desseyn J-L et al. J. Biol. Chem. 272:3168-78, 1997.
Chambers J et al., Genomics 38:305-313, 1996.
Genbank Accession No. AA640762.
Yin BWT et al. J. Biol. Chem. 276:27371-75, 2001.
O'Brien TJ et al., Tumor Biology 22:348-366, 2001.
O'Brien TJ et al. Tumor Biology 23:154-169, 2002.

(Continued)

*Primary Examiner* — Peter J Reddig
(74) *Attorney, Agent, or Firm* — Hugh McTavish

(57) ABSTRACT

The CA125 gene has been cloned and multiple repeat sequences as well as the carboxy terminus have been identified. The CA125 molecule comprises three major domains: an extracellular amino terminal domain (Domain 1); a large multiple repeat domain (Domain 2); and a carboxy terminal domain (Domain 3) which includes a transmembrane anchor with a short cytoplasmic domain. An amino terminal extension is present. The molecular structure is dominated by a repeat domain comprising 156 amino acid repeat units. More than 60 repeat units have been identified, sequenced, and contiguously placed in the CA125 domain structure. The repeat units encompass an interactive disulfide bridged C-enclosure and the site of OC125 and M11 binding. The repeat sequences demonstrated 70-85% homology to each other. Expression of the repeats was demonstrated in *E. coli*. The CA125 molecule is anchored at its carboxy terminal through a transmembrane domain and a short cytoplasmic tail.

1 Claim, 19 Drawing Sheets

(56) References Cited

OTHER PUBLICATIONS

Bast RC et al. New England J. Med. 309:883-887, 1983.
Lloyd KO et al., Tumor Biol. 22:77-82, 2001.
Marshall E Science 292:1982-1983, 2001.
Nustad K et al., Int. J. Biol. Markers 13:196-199, 1998.
Nustad K et al. Tumor Biology 17:196-219, 1996.
O'Brien TJ et al., Am. J. Obstet. Gynecol. 155:50-55, 1986.
O'Brien TJ et al., Am. J. Obstet. Gynecol. 165:1857-1864, 1991.
Quirk JG et al. Am. J. Obstet. Gynecol. 159:644-649, 1988.
Santin AD et al. Am. J. Obstet. Gynecol. 183:601-609, 2000.
Shigesmasa K et al. International J. of Gynecologic Cancer 7:296-303, 1997.
Shigesmasa K et al., J. Soc. Gynecol. Investigation 4:95-102 (1997).
Verma M et al., Glycoconjugate J. 11:172-179, 1994.
Wagner, U. et al. Hybridoma 16:33-40 (1997).
Wagner U et al., Clin. Cancer Res. 7:1112-1115, 2001.
Williams, SJ et al., J. Biol. Chem. 276:18327-18336, 2001.
Yin, TWT et al., J. Biol. Chem. 276:27371-27375, 2001.
Argueso et al.MUC16 mucin is expressed by the human ocular . . . Invest. Ophthalmol Vis. Sci 44:2487-95, 2003.
Coleman et al., Research in Immunology 145:33-36, 1994.
Abaza et al., J. Protein Chem. 1:433-444, 1992.
Rudikoff et al., Proc. Nat'l Acad. Sci. USA 79:1979-1983, 1982.
Burgess et al., J. Cell Biol. 111:2129-2138, 1990.
Ping Fu et al., J. Biochem. Biophys. Methods 40:101-112, 1999.
Ma NS et al. Owl monkey gene map: evidence for a homologous human chromosome 7q region near cystic fibrosis locus. Genomics 5:389-396, 1989.
Tanaka T et al. Efficient generation of antibodies to oncoproteins by usnig synthetic peptide antigens. Proc. Natl. Acad. Sci. USA 82:3400-3404, 1985.
Genbank Accession No. AC016584.
Genbank Accession No. AF414442.
Genbank Accession No. AF361486.
Roitt et al., 1998, Immunology, 4th ed. Mosby, section titled "The Structure of Antigens.".
Holmes, 2001, Exp. Opin. Invest. Drugs 10(3):511-519.
Greenspan et al., 1999, Nature Biotechnology 7:936-937.
Herbert et al., The Dictionary of Immunology, Academic Press, 4th edition, 1995, p. 58-59, "Epitope".
Bowie Ju et al. Science 247:1306-1310, 1990.
Goldsby R. et al., 2000, Kuby Immunology, fourth edition, WH Freeman and Co., New York, Chapter 3, Antigens, pp. 63-81.

\* cited by examiner

FIG. 3 (SEQ ID NOS: 158, 159, 160, and 161)

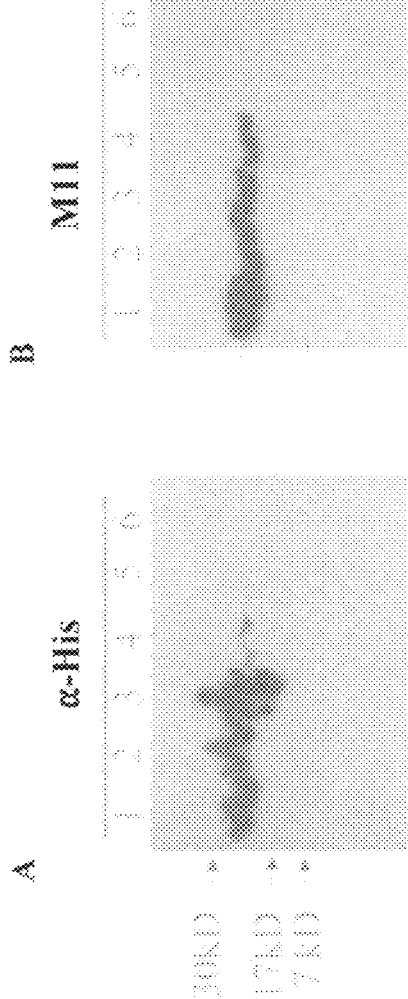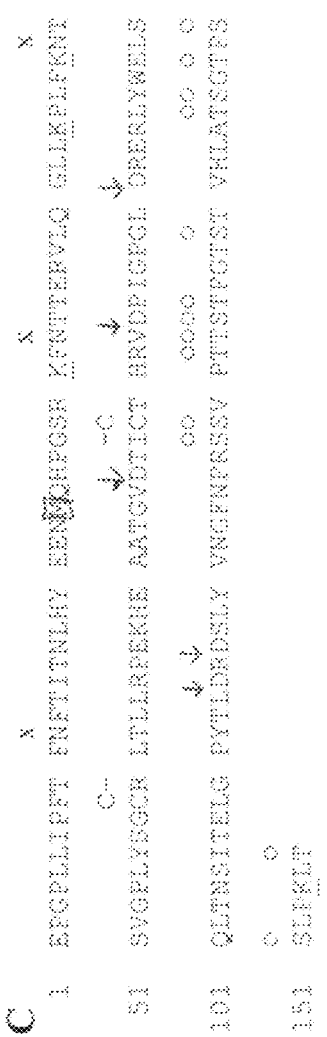
FIG. 5 (SEQ ID NO:150)

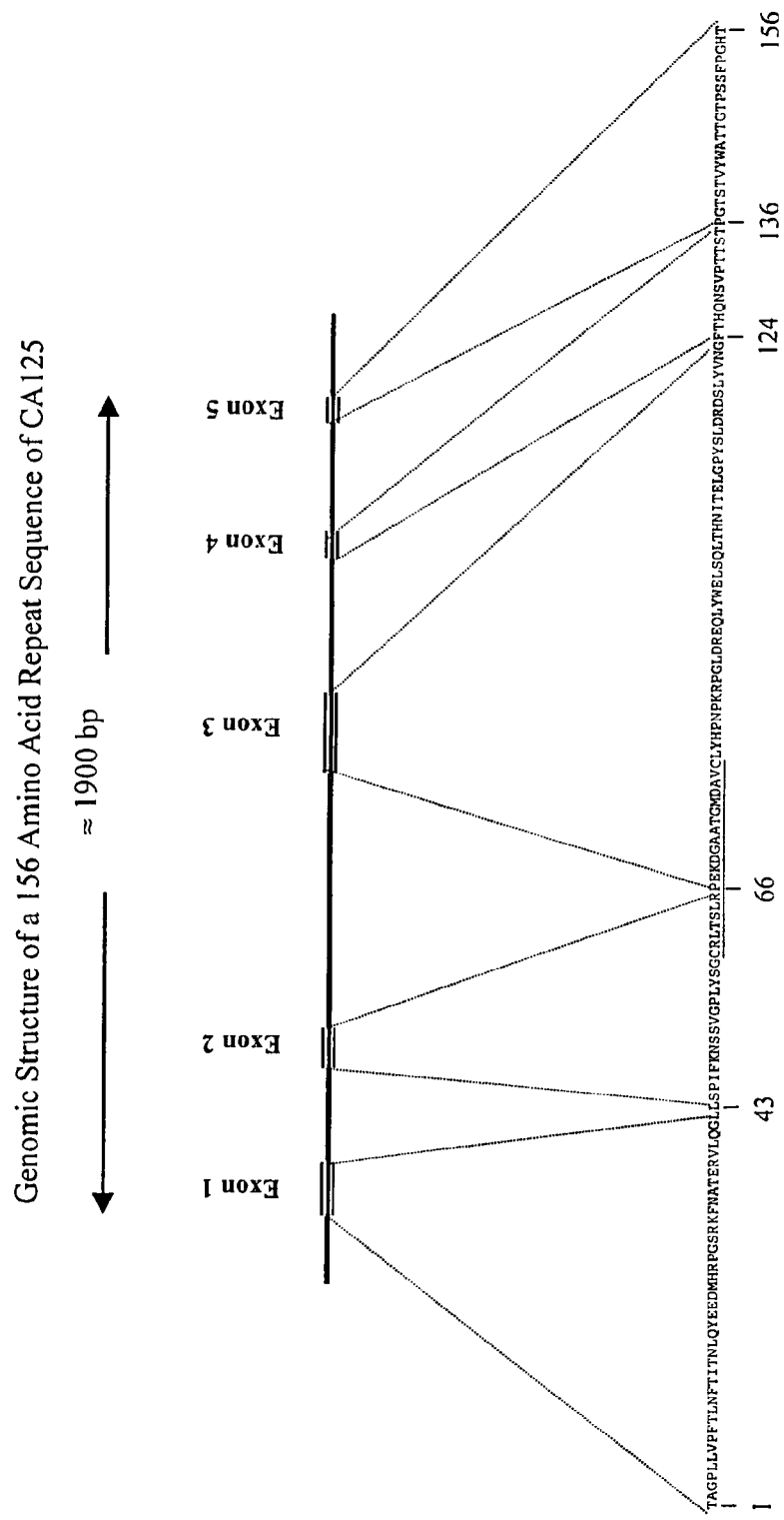
FIG. 7B (SEQ ID NO:163)

Exon 2

```
43                      65
LKPLFRNSSLEYLYSGCRLASLR    (SEQ ID NO: 195)
LKPLFKNTSVSSLYSGCRLTLLR    (SEQ ID NO: 196)
LKPLFKNTSVGPLYSGCRLTLLR    (SEQ ID NO: 197)
LKPLFKSTSVGPLYSGCRLTLLR    (SEQ ID NO: 198)
LKPLFKSTSVGPLYSSCRLTLLR    (SEQ ID NO: 199)
LKPLFKNTSVGPLYSGCRLTSLR    (SEQ ID NO: 200)
LGPIFKNTSVGPLYSGCRLTSLR    (SEQ ID NO: 201)
LGPMFKNTSVGLLYSGCRLTLLR    (SEQ ID NO: 202)
LGPMFKNTSVGPLYSGCRLTLLR    (SEQ ID NO: 203)
LGPMFKNTSVGPLYSGCRLTSLR    (SEQ ID NO: 204)
LGPLFKNSSVGPLYSGCRLISLR    (SEQ ID NO: 205)
LGPLFKNSSVDPLYSGCRLTSLR    (SEQ ID NO: 206)
LSPIFKNSSVGPLYSGCRLTSLR    (SEQ ID NO: 207)
LSPIFKNTSVGPLYSGCRLTLLR    (SEQ ID NO: 208)
LSPLFQRSSLGARYTGCRVIALR    (SEQ ID NO: 209)
LRPLFKNTSVSSLYSGCRLTLLR    (SEQ ID NO: 210)
LRPLFKNTSVGPLYSGSRLTLLR    (SEQ ID NO: 211)
LRPLFKNTSIGPLYSSCRLTLLR    (SEQ ID NO: 212)
LRPLFKSTSVGPLYSGCRLTLLR    (SEQ ID NO: 213)
LRPVFKNTSVGLLYSGCRLTLLR    (SEQ ID NO: 214)
LRPVFKNTSVGPLYSGCRLTLLR    (SEQ ID NO: 215)
LRSLFKSTSVGPLYSGCRLTLLR    (SEQ ID NO: 216)
LRSLFKSTSVGPLYSGCRLTSLR    (SEQ ID NO: 217)
LTPLFKNTSVGPLYSGCRLTLLR    (SEQ ID NO: 218)
LTPLFRNTSVSSLYSGCRLTLLR    (SEQ ID NO: 219)
LMPLFKNTSVSSLYSGCRLTLLR    (SEQ ID NO: 220)
RPLFQKSSN.GPFYLGCQLISLR    (SEQ ID NO: 221)
```

FIG. 7C

Exon 3

66                                                                                                          123

PEKDSSAMAVDAICTHRPDPEDLGLDRERLYWELSNLTNGIQELGPYTLDRNSLYVNG (SEQ ID NO: 222)
PEKDGAATGVDAICTHRLDPKSPGLNREQLYWELSKLTNDIEELGPYTLDRNSLYVNG (SEQ ID NO: 223)
PKKDGAATGVDAICTHRLDPKSPGLNREQLYWELSKLTNDIEELGPYTLDRNSLYVNG (SEQ ID NO: 224)
PEKDGTATGVDAICTHRPDPKSPRLDREQLYWELSQLTHNITELGHYALDNDSLFVNG (SEQ ID NO: 225)
PEKDGEATGVDAICTHRPDPTGPGLDREQLYLELSQLTHSITELGPYTLDRDSLYVNG (SEQ ID NO: 226)
PEKDGAATGMDAVCLYHPNPKRPGLDREQLYWELSQLTHNITELGPYSLDRDSLYVNG (SEQ ID NO: 227)
PEKDGAATGMDAVCLYHPNPKRPGLDREQLYCELSQLTHNITELGPYSLDRDSLYVNG (SEQ ID NO: 228)
PEKDGAATRVDAACTYRPDPKSPGLDREQLYWELSQLTHSITELGPYTLDRVSLYVNG (SEQ ID NO: 229)
PKKDGAATRVDAICTYRPDPKSPGLDREQLYWELSQLTHSITELGPYTQDRDSLYVNG (SEQ ID NO: 230)
PKKDGAATRVDAICTYRPDPKSPGLDREQLYWELSQLTHSITELGPYTQDRDSLYNVG (SEQ ID NO: 231)
PEKDGAATRVDAVCTHRPDPKSPGLDRERLYWKLSQLTHGITELGPYTLDRHSLYVNG (SEQ ID NO: 232)
PEKDGVATRVDAICTHRPDPKIPGLDRQQLYWELSQLTHSITELGPYTLDRDSLYVNG (SEQ ID NO: 233)
SEKDGAATGVDAICIHHLDPKSPGLNRERLYWELSQLTNGIKELGPYTLDRNSLYVNG (SEQ ID NO: 234)
SEKDGAATGVDAICTHRLDPKSPGLDREQLYWELSQLTNGIKELGPYTLDRNSLYVNG (SEQ ID NO: 235)
SEKDGAATGVDAICTHRLDPKSPGVDREQLYWELSQLTNGIKELGPYTLDENSLYVNG (SEQ ID NO: 236)
SEKDGAATGVDAICTHRVDPKSPGVDREQLYWELSQLTNGIKELGPYTLDRNSLYVNG (SEQ ID NO: 237)
SEKDGAATGVDAICTHHLNPQSPGLDREQLYWQLSQHTNGIKELGPYTLDRNSLYVNG (SEQ ID NO: 238)
PEKRGAATGVDTICTHRLDPLNPGLDREQLYWELSKLTRGIIELGPYLLDRGSLYVNG (SEQ ID NO: 239)
PEKNGAATGMDAICSHRLDPKSPGLNREQLYWELSQLTHGIKELGPYTLDRNSLYVNG (SEQ ID NO: 240)
PEKNGAATGMDAICSHRLDPKSPGLDREQLYWELSQLTHGIKELGPYTLDRNSLYVNG (SEQ ID NO: 241)
PEKHGAATGVDAICTLRLDPTGPGLDRERLYWELSQLTNSVTELGPYTLDRDSLYVNG (SEQ ID NO: 242)
PEKHGAATGVDAICTLRLDPTGPGLDRERLYWELSQLTNSITELGPYTLDRDSLYVNG (SEQ ID NO: 243)
PEKHEAATGVDTICTHRVDPIGPGLDRERLYWELSQLTNSITELGPYTLDRDSLYVNG (SEQ ID NO: 244)
PEKQEAATGVDTICTHRVDPIGPGLDRERLYWELSQLTNSITELGPYTLDRDSLYVNG (SEQ ID NO: 245)
PEKQEAATGVDTICTHRVDPIGPGLDRERLYWELSQLTNSITELGPYTLDRDSLYVDG (SEQ ID NO: 246)
PEKDKAATRVDAICTHHPDPQSPGLNREQLYWELSQLTHGITELGPYTLDRDSLYVDG (SEQ ID NO: 247)
SVKNGAETRVDLLCTYLQPLSGPGLPIKQVFHELSQQTHGITRLGPYSLDRDSLYING (SEQ ID NO: 248)
PEKDGAATGVDTTCTYHPDPVGPGLDIQQLYWELSQLTHGVTQLGFYVLDRDSLFING (SEQ ID NO: 249)

FIG. 7D

Exon 4

124        135

FTHRSSMPTTST (SEQ ID NO: 250)
FTHRSSMPTTSI (SEQ ID NO: 251)
FTHRTSVPTSST (SEQ ID NO: 252)
FTHRISVPTTST (SEQ ID NO: 253)
FTHRSSVPTTSS (SEQ ID NO: 254)
FTERSSVSTTST (SEQ ID NO: 255)
FTHRSSVAPTST (SEQ ID NO: 256)
FTHRSSGLTTST (SEQ ID NO: 257)
FTERSFGLTTST (SEQ ID NO: 258)
FTHRSSFLTTST (SEQ ID NO: 259)
FTHRNFVPITST (SEQ ID NO: 260)
FTHRSSVPTTSI (SEQ ID NO: 261)
FTHQSSVSTTST (SEQ ID NO: 262)
FTHQTSAPNTST (SEQ ID NO: 263)
FTHQTFAPNTST (SEQ ID NO: 264)
FTHQNSVPTTST (SEQ ID NO: 265)
FTHQSSMTTTRI (SEQ ID NO: 266)
FTHWIPVPTSST (SEQ ID NO: 267)
FTHWSPIPTTST (SEQ ID NO: 268)
FTHWSSGLTTST (SEQ ID NO: 269)
FHPRSSVPTTST (SEQ ID NO: 270)
FNPRSSVPTTST (SEQ ID NO: 271)
FNPWSSVPTTST (SEQ ID NO: 272)
FTQRSSVPTTSI (SEQ ID NO: 273)
FTQRSSVPTTST (SEQ ID NO: 274)
FTQRSSVPTTSV (SEQ ID NO: 275)
YHEPGLDEPPTT (SEQ ID NO: 276)
YAPQNLSIRGEY (SEQ ID NO: 277)

Exon 5

136                156

PGTSTVDVGTSGTPSSSPSPT (SEQ ID NO: 278)
PGTSTVDLRTSGTPSSLSSPTIM (SEQ ID NO: 279)
PGTSTVDLGTSGTPFSLPSPA (SEQ ID NO: 280)
PGTSTVDLG.SGTPSSLPSPT (SEQ ID NO: 281)
PGTSTVDLG.SGTPSLPSSPT (SEQ ID NO: 282)
PGTSTVDLGTSGTPSSLPSPT (SEQ ID NO: 283)
PGTPTVDLGTSGTPVSRPGPS (SEQ ID NO: 284)
PWTSTVDLGTSGTPSPVPSPT (SEQ ID NO: 285)
PGTSTVYWATTGTPSSFPGHT (SEQ ID NO: 286)
PGTSTVHLATSGTPSSLPGHT (SEQ ID NO: 287)
PGTSTVHLATSGTPSPLPGHT (SEQ ID NO: 288)
PDTSTMHLATSRTPASLSGPT (SEQ ID NO: 289)
PGTSAVHLETSGTPASLPGHT (SEQ ID NO: 290)
PGTSAVHLETTGTPSSFPGHT (SEQ ID NO: 291)
PGTSTVHLGTSETPSSLPRPI (SEQ ID NO: 292)
PGTSIVNLGTSGIPPSLPETT (SEQ ID NO: 293)
PGTFTVQPETSETPSSLPGPT (SEQ ID NO: 294)
PGTPTVDLGTSGTPVSKPGPS (SEQ ID NO: 295)
PGTPTVYLGASETPASIFGPS (SEQ ID NO: 296)
PKPATTFLPPLSEATT..... (SEQ ID NO: 297)
QINFHIVNWNLSNPDPTSSEY (SEQ ID NO: 298)

FIG. 7E

```
   1  MEHITKIPNE AAHRGTIRPV KGPQTSTSPA SPKGLHTGGT KRMETTTTAL ISATFPTVPE SPHESEATAS WVTHPAVTST TVPRTTPNYS HSEPDTTPSI
  51  KTTTTALKTT SRATLTTSVY TPTLGTLTPL NASRQMASTI LTEMMITTPY ATSPGAEATS DFPTITVSPD VPDMVTSQVT SSGTDTSITI PTLTLSSGEP
 101  VFPDVPETTS SLATSLGAET STALPRTTPS VLNRESETTA SLVSRSGAER ETTTSFITYS ETHTSSAIPT LPVSPGASKM LISLVISSGT DSTTTFPTLT
 151  SPVIQTLDVS SSEPDTTASW VIHPAETIPT VSKTTPNFFH SELDTVSSTA ETPYEPETTA IQLIHPAETN TMVPRTTPKF SHSKSDTTLP VAITSPGPEA
 201  TSHGADVSSA IPTNISPSEL DALTPLVTIS GTDTSTTFPT LTKSPHETET SSAVSTTTIS PDMSDLVTSL VPSSGTDTST TFPTLSETPY EPETTATWLT
 251  RTTWLTHPAE TSSTIPRTIP NFSHHESDAT PSIATSPGAE TSSAIPIMTV HPAETSTTVS GTIPNFSHRG SDTAPSMVTS PGVDTRSGVP TTTIPPSIPG
 301  SPGAEDLVTS QVTSSGTDRN MTIPTLTLSP GEPKTIASLV THPEAQTSSA VVTSQVTSSA TDTSTAIPTL TPSPGEPETT ASSATHPGTQ TGFTVPIRTV
 351  IPTSTISPAV SRLVTSMVTS LAAKTSTTNR ALTNSPGEPA TTVSLVTHPA PSSEPDTMAS WVTHPPQTST PVSRTTSSFS HSSPDATPVM ATSPRTEASS
 401  QTSPTVPWTT SIFFHSKSDT TPSMTTSHGA ESSSAVPTPT VSTEVPGVVT AVLTTISPGA PEMVTSQITS SGAATSTTVP TLTHSPGMPE TTALLSTHPR
 451  PLVTSSRAVI STTIPILTLS PGEPETTPSM ATSHGEEASS AIPTPTVSPG TETSKTFPAS TVFPQVSETT ASLTIRPGAE TSTALPTQTT SSLFTLLVTG
 501  VPGVVTSLVT SSRAVTSTTI PILTFSLGEP ETTPSMATSH GTEAGSAVPT TSRVDLSPTA SPGVSAKTAP LSTHPGTETS TMIPTSTLSL GLLETTGLLA
 551  VLPEVPGMVT SLVASSRAVT STTLPTLTLS PGEPETTPSM ATSHGAEASS TSSSAETSTS TLTLTVSPAV SGLSSASITT DKPQTVTSWN TETSPSVTSV
 601  TVPTVSPEVP GVVTSLVTSS SGVNSTSIPT LILSPGELET TPSMATSHGA GPPEFSRTVT GTTMTLIPSE MPTPPKTSHG EGVSPTTILR TTMVEATNLA
 651  EASSAVPTPT VSPGVSGVVT PLVTSSRAVT STTIPILTLS SSEPETTPSM TTGSSPTVAK TTTTFNTLAG SLFTPLTTPG MSTLASESVT SRTSYNHRSW
 701  ATSHGVEASS AVLTVSPEVP GMVTSLVTSS RAVTSTTIPT LTISSDEPET ISTTSSYNRR YWTPATSTPV TSTFSPGIST SSIPSSTAAT VPPMVPFTLN
 751  TTSLVTHSEA KMISAIPTLA VSPTVQGLVT SLVTSSGSET SAFSNLTVAS FTITNLQYEE DMRHPGSRKF NATERELQGL LKPLFRNSSL EYLYSGCRLA
 801  SQPETIDSWV AHPGTEASSV VPTLTVSTGE PFTNISLVTH PAESSSTLPR SLRPEKDSSA MAVDAICTHR PDPEDIGLDR ERLYWELSNL TNGIQELGPY
 851  TTSRFSHSEL DTMPSTVTSP EAESSSAIST TISPGIPGVL TSLVTSSGRD TLDRNSLYVN GFTHRSSMPT TSTPGTSTVD VGTSGTPSSS PSPT
```

FIG. 8B (SEQ ID NO:299)

```
  1   ITLLRDIQDK  VTTLYKGSQL  HDTFRFCLVT  NLTMDSVLVT  VKALFSSNLD
      |←— Exon 1 —→|←————————— Exon 2 —————————→|←——————————————
                      x                                    oo
 51   PSLVEQVFLD  KTLNASFHWL  GSTYQLVDIH  VTEMESSVYQ  PTSSSSTQHF
      ——————— Exon 3 ————————————————————→|←—————————
          x                                       x
101   YLNFTITNLP  YSQDKAQPGT  TNYQRNKRNI  EDALNQLFRN  SSIKSYFSDC
      ——————————— Exon 4 ————————————————→|←——————— Exon 5
                                                       x    x
151   QVSTFRSVPN  RHHTGVDSLC  NFSPLARRVD  RVAIYEEFLR  MTRNGTQLQN
      ————————→|←——————————————————— Exon 6 —————————————————
201   FTLDRSSVLV  DGYSPNRNEP  LTGNSDLPFW  AVILIGLAGL  LGLITCLICG
      ——————————————→|←— Exon 7 —→|←————— Exon 8 —————
251   VLVTTRRRKK  EGEYNVQQQC  PGYYQSHLDL  EDLQ
      →|←—————— Exon 9 ——————————————————→|
``` x

FIG. 9B (SEQ ID NO:300)

CA125 GENE AND ITS USE FOR DIAGNOSTIC AND THERAPEUTIC INTERVENTIONS

This application is a continuation of U.S. patent application Ser. No. 10/475,117, filed Oct. 17, 2003, issued as U.S. Pat. No. 8,124,728, which is a continuation-in-part of PCT/US02/11734 filed Apr. 12, 2002, which claims priority under 35 U.S.C. §119(e) from U.S. Provisional Application Ser. No. 60/284,175 filed Apr. 17, 2001, U.S. Provisional Application Ser. No. 60/299,380 filed Jun. 19, 2001, and U.S. Provisional Application Ser. No. 60/345,180 filed Dec. 21, 2001. This application is a continuation-in-part of U.S. application Ser. No. 09/965,738, issued as U.S. Pat. No. 7,309,760, filed Sep. 27, 2001, through PCT/US02/11734. This application claims priority under 35 U.S.C. §119(e) from provisional application 60/427,045 (filed Nov. 15, 2002). All of these cited applications are hereby specifically incorporated by reference. Applicant hereby specifically claims the benefit of these prior filed applications under 35 U.S.C. §§119(e), 120 and 365.

BACKGROUND OF THE INVENTION

The present invention relates generally to the cloning, identification, and expression of the CA125 gene's glycosylated amino terminal domain, the multiple repeat domain, and the carboxy terminal domain in vitro and, more specifically, to the use of recombinant CA125 with epitope binding sites for diagnostic and therapeutic purposes. Additionally, the genomic DNA, a molecule encoding a 5' upstream region of CA125 and a genomic DNA sequence for the amino terminal, extra cellular repeats and carboxy terminal of CA125 has been determined.

CA125 is an antigenic determinant located on the surface of ovarian carcinoma cells with essentially no expression in normal adult ovarian tissue. Elevated in the sera of patients with ovarian adenocarcinoma, CA125 has played a critical role for more than 15 years in the management of these patients relative to their response to therapy and also as an indicator of recurrent disease.

It is well established that CA125 is not uniquely expressed in ovarian carcinoma, but is also found in both normal secretory tissues and other carcinomas (i.e., pancreas, liver, colon) [Hardardottir H et al., Distribution of CA125 in embryonic tissue and adult derivatives of the fetal periderm, *Am J Obstet. Gynecol.* 163; 6(1):1925-1931 (1990); Zurawski V R et al., Tissue distribution and characteristics of the CA125 antigen, *Cancer Rev.* 11-12:102-108 (1988); and O'Brien T J et al., CA125 antigen in human amniotic fluid and fetal membranes, *Am J Obstet Gynecol.* 155:50-55, (1986); Nap M et al., Immunohistochemical characterization of 22 monoclonal antibodies against the CA125 antigen: 2nd report from the ISOBM TD-1 workshop, Tumor Biology 17:325-332 (1996)]. Notwithstanding, CA125 correlates directly with the disease status of affected patients (i.e., progression, regression, and no change), and has become the "gold standard" for monitoring patients with ovarian carcinoma [Bast R C et al., A radioimmunoassay using a monoclonal antibody to monitor the course of epithelial ovarian cancer, *N Engl J Med.* 309:883-887 (1983); and Bon G C et al., Serum tumor marker immunoassays in gynecologic oncology: Establishment of reference values, *Am J Obstet. Gynecol.* 174:107-114 (1996)]. CA125 is especially useful in post-menopausal patients where endometrial tissue has become atrophic and, as a result, is not a major source of normal circulating CA125.

During the mid 1980's, the inventor of the present invention and others developed M11, a monoclonal antibody to CA125. M11 binds to a dominant epitope on the repeat structure of the CA125 molecule [O'Brien T J et al., New monoclonal antibodies identify the glycoprotein carrying the CA125 epitope, *Am J Obstet Gynecol* 165:1857-64 (1991)]. More recently, the inventor and others developed a purification and stabilization scheme for CA125, which allows for the accumulation of highly purified high molecular weight CA125 [O'Brien T J et al., More than 15 years of CA125: What is known about the antigen, its structure and its function, *Int J Biological Markers* 13(4):188-195 (1998)].

Considerable progress has been made over the years to further characterize the CA125 molecule, its structure and its function. The CA125 molecule is a high molecular weight glycoprotein with a predominance of O-linked sugar side chains. The native molecule exists as a very large complex (~2-5 million daltons). The complex appears to be composed of an epitope containing CA125 molecule and binding proteins which carry no CA125 epitopes. The CA125 molecule is heterogenous in both size and charge, most likely due to continuous deglycosylation of the side chains during its lifespan in bodily fluids. The core CA125 subunit is in excess of 200,000 daltons, and retains the capacity to bind both OC125 and M11 class antibodies.

Despite the advances in detection and quantitation of serum tumor markers like CA125, the majority of ovarian cancer patients are still diagnosed at an advanced stage of the disease—Stage III or IV. Further, the management of patients' responses to treatment and the detection of disease recurrence remain major problems. There, thus, remains a need to significantly improve and standardize current CA125 assay systems. Further, the development of an early indicator of risk of ovarian cancer will provide a useful tool for early diagnosis and improved prognosis.

SUMMARY OF THE INVENTION

The genomic DNA and a full-length cDNA sequence of human CA125 has been determined. Additionally, a nucleic acid molecule encoding a 5' upstream region of the CA125 gene has been determined.

The genomic sequence for CA125 and a 5' upstream region has been determined. A DNA sequence showing the 5' upstream region and the amino terminal portion of the CA125 molecule is set out in Table 27. The extracellular amino terminal domain is made of exons: Exon 1 from 2205-11679; Exon 2 from 13464-13570; Exon 3 from 16177-34419; Exon 4 from 34575-38024; Exon 5 from 38689-38800; Exon 6 from 40578-45257; Exon 7 from 47360-47395; Exon 8 from 52407-52442; Exon 9 from 52686-52744 as set out in SEQ ID NO 311. A DNA sequence showing the extracellular repeat portion of the CA125 molecule is set out in Table 28. The repeat portion is made of exons: Exon R1 from 1-130; Exon R2 from 442-510; Exon R3 from 5479-5652; Exon R4 from 6301-6334; Exon R5 from 6593-6657; Exon R1 from 7558-7683; Exon R2 from 8216-8284; Exon R3 from 8877-9050; Exon R4 from 9380-9413; Exon R5 from 9675-9739; Exon R1 from 10201-10291; Exon R2 from 10524-10592; Exon R3 from 11200-11373; Exon R4 from 11722-11755; Exon R5 from 12016-12036; Exon R1 from 12169-12295; Exon R2 from 12532-12600; Exon R3 from 13219-13392; Exon R4 from 13723-13756; Exon R5 from 14016-14077; Exon R1 from 15001-15126; Exon R2 from 15367-15435; Exon R1 from 15648-15773; Exon R2 from 16002-16070; Exon R3 from 16653-16826; Exon R4 from 17158-17191; Exon R5 from 17453-17517; Exon R1 from 18532-18657; Exon R2 from 18888-18956; Exon R3 from 19633-19806; Exon R4 from 20141-20176; Exon R5 from 20387-20449; Exon R1 from 21609-21731; Exon R2 from 21940-22008; Exon R3 from 22605-22778; Exon R4 from 23109-23142; Exon R1 from 29046-29168; Exon R2 from 29266-29334; Exon R3 from 33917-34090; Exon R4 from 36702-36734; Exon R5 from 38270-38320; Exon R1 from 39104-39224; Exon R2 from 39315-39383; Exon R3 from 39532-39705; Exon R4 from 41862-41992 as set out in SEQ ID NO 312. A DNA sequence showing the carboxy terminal domain of the CA125 molecule is set out in Table 29. The carboxy terminal portion is made of exons: Exon C1 from 1-66; Exon C2 from 1802-1947; Exon C3 from 4198-4350; Exon C4 from 4679-4747; Exon C5 from 6811-6978; Exon C6 from 11232-11270; Exon C7 from 11594-11677; Exon C8 from 14095-14187 as set out in SEQ ID NO 313. A full length cDNA molecule for CA125 is set out in Table 30 and SEQ ID NO 314. A CA125 protein is set out in Table 31 and SEQ ID NO 315.

The CA125 gene has been cloned and multiple repeat sequences as well as the glycosylated amino terminal and the carboxy terminus have been identified. CA125 requires a transcript of more than 35,000 bases and occupies approximately 150,000 bp on chromosome 19q 13.2. The CA125 molecule comprises three major domains: an extracellular amino terminal domain (Domain 1); a large multiple repeat domain (Domain 2); and a carboxy terminal domain (Domain 3) which includes a transmembrane anchor with a short cytoplasmic domain. The amino terminal domain is assembled by combining five genomic exons, four very short amino terminal sequences and one extraordinarily large exon. This domain is dominated by its capacity for O-glycosylation and its resultant richness in serine and threonine residues. Additionally, an amino terminal extension is present, which comprises four genomic exons. Analysis of the amino terminal extension revealed that its amino acid composition is consistent with the amino acid composition of the amino terminal domain.

The extracellular repeat domain, which characterizes the CA125 molecule, also represents a major portion of the CA125 molecular structure. It is downstream from the amino terminal domain and presents itself in a much different manner to its extracellular matrix neighbors. These repeats are characterized by many features including a highly-conserved nature and uniformity in exon structure. But most consistently, a cysteine enclosed sequence may form a cysteine loop. Domain 2 comprises 156 amino acid repeat units of the CA125 molecule. The repeat domain constitutes the largest proportion of the CA125 molecule. The repeat units also include the epitopes now well-described and classified for both the major class of CA125 antibodies of the OC125 group and the M11 group. More than 60 repeat units have been identified, sequenced, and contiguously placed in the CA125 domain structure. The repeat sequences demonstrated 70-85% homology to each other. The existence of the repeat sequences was confirmed by expression of the recombinant protein in *E. coli* where both OC125/M11 class antibodies were found to bind to sites on the CA125 repeat.

The CA125 molecule is anchored at its carboxy terminal through a transmembrane domain and a short cytoplasmic tail. The carboxy terminal also contains a proteolytic cleavage site approximately 50 amino acids upstream from the transmembrane domain, which allows for proteolytic cleavage and release of the CA125 molecule. The identification and sequencing of multiple repeat domains of the CA125 antigen provides potentially new clinical and therapeutic applications for detecting, monitoring and treating patients with ovarian cancer and other carcinomas where CA125 is expressed. For example, the ability to express repeat domains of CA125 with the appropriate epitopes would provide a much needed standard reagent for research and clinical applications. Current assays for CA125 utilize as standards either CA125 produced from cultured cell lines or from patient ascites fluid. Neither source is defined with regard to the quality or purity of the CA125 molecule. The present invention overcomes the disadvantages of current assays by providing multiple repeat domains of CA125 with epitope binding sites. At least one or more of any of the more than 60 repeats shown in Table 16 can be used as a "gold standard" for testing the presence of CA125. Furthermore, new and more specific assays may be developed utilizing recombinant products for antibody production.

Perhaps even more significantly, the multiple repeat domains of CA125 or other domains could also be used for the development of a potential vaccine for patients with ovarian cancer. In order to induce cellular and humoral immunity in humans to CA125, murine antibodies specific for CA125 were utilized in anticipation of patient production of anti-ideotypic antibodies, thus indirectly allowing the induction of an immune response to the CA125 molecule. With the availability of recombinant CA125, especially domains which encompass epitope binding sites for known murine antibodies, it will be feasible to more directly stimulate patients' immune systems to CA125 and, as a result, extend the life of ovarian carcinoma patients.

The recombinant CA125 of the present invention may also be used to develop therapeutic targets. Molecules like CA125, which are expressed on the surface of tumor cells, provide potential targets for immune stimulation, drug delivery, biological modifier delivery or any agent which can be specifically delivered to ultimately kill the tumor cells. Humanized or human antibodies to CA125 epitopes could be used to deliver all drug or toxic agents including radioactive agents to mediate direct killing of tumor cells. Natural ligands having a natural binding affinity for domains on the CA125 molecule could also be utilized to deliver therapeutic agents to tumor cells.

CA125 expression may further provide a survival or metastatic advantage to ovarian tumor cells. Antisense oligonucleotides derived from the CA125 repeat sequences could be used to down-regulate the expression of CA125. Further, antisense therapy could be used in association with a tumor cell delivery system of the type described above.

Recombinant domains of the CA125 molecule also have the potential to identify small molecules, which bind to individual domains of the CA125 molecule. These small molecules could also be used as delivery agents or as biological modifiers.

In one aspect of the present invention, a CA125 molecule is disclosed comprising: (a) an extracellular amino terminal domain, comprising 5 genomic exons, wherein exon 1 comprises amino acids #1-33 of SEQ ID NO: 299, exon 2 comprises amino acids #34-1593 of SEQ ID NO: 299, exon 3 comprises amino acids #1594-1605 of SEQ ID NO: 299, exon 4 comprises amino acids #1606-1617 of SEQ ID NO: 299, and exon 5 comprises amino acids #1618-1637 of SEQ ID NO: 299; (b) an amino terminal extension, comprising 4 genomic exons, wherein exon 1 comprises amino acids #1-3157 of SEQ ID NO: 310, exon 2 comprises amino acids #3158-3193 of SEQ ID NO: 310, exon 3 comprises amino acids #3194-9277 of SEQ ID NO: 310, and exon 4 comprises amino acids #9278-10,427 of SEQ ID NO: 310; (c) a multiple repeat domain, wherein each repeat unit comprises 5 genomic exons, wherein exon 1 comprises amino acids #1-42 in any of SEQ ID NOS: 164 through 194; exon 2 comprises amino acids #43-65 in any of SEQ ID NOS: 195 through 221; exon 3 comprises amino acids #66-123 in any of SEQ ID NOS: 222 through 249; exon 4 comprises amino acids #124-135 in any of SEQ ID NOS: 250 through 277; and exon 5 comprises amino acids #136-156 in any of SEQ ID NOS: 278 through 298; and (d) a carboxy terminal domain comprising a transmembrane anchor with a short cytoplasmic domain, and further comprising 9 genomic exons, wherein exon 1 comprises amino acids #1-11 of SEQ ID NO: 300; exon 2 comprises amino acids #12-33 of SEQ ID NO: 300; exon 3 comprises amino acids #34-82 of SEQ ID NO: 300; exon 4 comprises amino acids #83-133 of SEQ ID NO: 300; exon 5 comprises amino acids #134-156 of SEQ ID NO: 300; exon 6 comprises amino acids #157-212 of SEQ ID NO: 300; exon 7 comprises amino acids #213-225 of SEQ ID NO: 300; exon 8 comprises amino acids #226-253 of SEQ ID NO: 300; and exon 9 comprises amino acids #254-284 of SEQ ID NO: 300.

In another aspect of the invention, the repeats comprise amino acids selected from the group consisting of SEQ ID NO 11-46, 69-80 and 58-161, wherein the repeats in any of the repeats are in any order.

In another aspect of the present invention, the N-glycosylation sites of the amino terminal domain marked (x) in FIG. 8B are encoded at positions #81, #271, #320, #624, #795, #834, #938, and #1,165 in SEQ ID NO: 299.

In another aspect of the present invention, the serine and threonine O-glycosylation pattern for the amino terminal domain is marked (o) in SEQ ID NO: 299 in FIG. 8B.

In another aspect of the present invention, the N-glycosylation sites of the amino terminal extension marked (x) in Table 26 are encoded at positions #139, #434, #787, #930, #957, #1266, #1375, #1633, #1840, #1877, #1890, #2345, #2375, #2737, #3085, #3178, #3501, #4221, #4499, #4607, #4614, #4625, #5048, #5133, #5322, #5396, #5422, #5691, #5865, #6090, #6734, #6861, #6963, #8031, #8057, #8326, #8620, #8686, #8915, #9204, #9495, #9787, #10, 077, and #10, 175.

In another aspect, the serine and threonine O-glycosylation pattern for the amino terminal extension is marked (o) in Table 26.

In another aspect of the present invention, exon 1 in the repeat domain comprises at least 31 different copies; exon 2 comprises at least 27 different copies; exon 3 comprises at least 28 different copies; exon 4 comprises at least 28 different copies, and exon 5 comprises at least 21 different copies.

In another aspect of the present invention, the repeat domain comprises 156 amino acid repeat units which comprise epitope binding sites. The epitope binding sites are located in at least part of the C-enclosure at amino acids #59-79 (marked C-C) in SEQ ID NO: 150 in FIG. 5.

In another aspect, the 156 amino acid repeat unit comprises O-glycosylation sites at positions #128, #129, #132, #133, #134, #135, #139, #145, #146, #148, #150, #151, and #156 in SEQ ID NO: 150 in FIG. 5C. The 156 amino acid repeat unit further comprises N-glycosylation sites at positions #33 and #49 in SEQ ID NO: 150 in FIG. 5C. The repeat unit also includes at least one conserved methionine (designated M) at position #24 in SEQ ID NO: 150 in FIG. 5C.

In another aspect of the invention, the multiple repeat domain is made of repeats selected from SEQ ID NOS 11-46, 69-80 and 58-161, wherein the repeat units are in any order.

In yet another aspect, the transmembrane domain of the carboxy terminal domain is located at positions #230-252 (underlined) in SEQ ID NO: 300 of FIG. 9B. The cytoplasmic domain of the carboxy terminal domain comprises a highly basic sequence adjacent to the transmembrane at positions #256-260 in SEQ ID NO: 300 of FIG. 9B, serine and threonine phosporylation sites at positions #254, #255, and #276 in SEQ ID NO: 300 in FIG. 9B, and tyrosine phosphorylation sites at positions #264, #273, and #274 in SEQ ID NO: 300 of FIG. 9B.

In another aspect of the present invention, an isolated nucleic acid of the CA125 gene is disclosed, which comprises a nucleotide sequence selected from the group consisting of: (a) the nucleotide sequences set forth in SEQ ID NOS: 311, 312, 313 and 314; (b) a nucleotide sequence having at least 70% sequence identity to any one of the sequences in (a); (c) a degenerate variant of any one of (a) to (b); and (d) a fragment of any one of (a) to (c).

In another aspect of the present invention, an isolated nucleic acid of the CA125 gene, comprising a sequence that encodes a polypeptide with the amino acid sequence selected from the group consisting of: (a) the amino acid sequences set forth in SEQ ID NO: 315; (b) an amino acid sequence having at least 50% sequence identity to any one of the sequences in (a); (c) a conservative variant of any one of (a) to (b); and (d) a fragment of any one of (a) to (c).

In yet another aspect, a vector comprising the nucleic acid of the CA125 gene is disclosed. The vector may be a cloning vector, a shuttle vector, or an expression vector. A cultured cell comprising the vector is also disclosed.

In yet another aspect, a method of expressing CA125 antigen in a cell is disclosed, comprising the steps of: (a) providing at least one nucleic acid comprising a nucleotide sequence selected from the group consisting of: (i) the nucleotide sequences set forth in SEQ ID NOS: 49, 67, 81, 83-145, 147, 150, and 152; (ii) a nucleotide sequence having at least 70% sequence identity to any one of the sequences in (i); (iii) a degenerate variant of any one of (i) to (ii); and (iv) a fragment of any one of (i) to (iii); (b) providing cells comprising an mRNA encoding the CA125 antigen; and (c) introducing the nucleic acid into the cells, wherein the CA125 antigen is expressed in the cells.

In yet another aspect, a purified polypeptide of the CA125 gene, comprising an amino acid sequence selected from the group consisting of: (a) the amino acid sequences set forth in SEQ ID NOS: 11-48, 50, 68-80, 82, 146, 148, 149, 150, 151, and 153-158; (b) an amino acid sequence having at least 50% sequence identity to any one of the sequences in (a); (c) a conservative variant of any one of (a) to (b); and (d) a fragment of any one of (a) to (c).

In another aspect, a purified antibody that selectively binds to an epitope in the receptor-binding domain of CA125 protein, wherein the epitope is within the amino acid sequence selected from the group consisting of: (a) the amino acid sequences set forth in SEQ ID NOS: 11-48, 50, 68-80, 146, 151, and 153-158; (b) an amino acid sequence having at least 50% sequence identity to any one of the sequences in (a); (c) a conservative variant of any one of (a) to (b); and (d) a fragment of any one of (a) to (c).

More specifically, this invention relates to a purified antibody that selectively binds to an epitope in the CA125 protein of SEQ ID NO 315. Similarly, the purified antibody selectively binds to an amino acid sequence having at least 50% sequence identity to said sequence; the purified antibody selectively binds to an amino acid sequence having at least 60% sequence identity to said sequence; the purified antibody selectively binds to an amino acid sequence having at least 70% sequence identity to said sequence; the purified antibody selectively binds to an amino acid sequence having at least 80% sequence identity to said sequence; and the purified antibody selectively binds to an amino acid sequence having at least 90% sequence identity to said sequence. Additionally, purified antibody can be a conservative variant of the amino acid sequence set forth in SEQ ID NO 315 or a fragment thereof.

A diagnostic for detecting and monitoring the presence of CA125 antigen is also disclosed, which comprises recombinant CA125 comprising at least one repeat unit of the CA125 repeat domain including epitope binding sites selected from the group consisting of amino acid sequences set forth in SEQ ID NOS: 11-48, 50, 68-80, 82, 146, 150, 151, 153-161, and 162 (amino acids #1,643-11,438).

A therapeutic vaccine to treat mammals with elevated CA125 antigen levels or at risk of developing a disease or disease recurrence associated with elevated CA125 antigen levels is also disclosed. The vaccine comprises recombinant CA125 repeat domains including epitope binding sites, wherein the repeat domains are selected from the group of amino acid sequences consisting of SEQ ID NOS: 11-48, 50, 68-80, 82, 146, 148, 149, 150, 151, 153-161, and 162 (amino acids #1,643-11,438), and amino acids #175-284 of SEQ ID NO: 300. Mammals include animals and humans.

In another aspect of the present invention, an antisense oligonucleotide is disclosed that inhibits the expression of CA125 encoded by: (a) the nucleotide sequences set forth in SEQ ID NOS: 49, 67, 81, 83-145, 147, 150, and 152; (b) a nucleotide sequence having at least 70% sequence identity to any one of the sequences in (a); (c) a degenerate variant of any one of (a) to (b); and (d) a fragment of any one of (a) to (c).

The preceding and further aspects of the present invention will be apparent to those of ordinary skill in the art from the following description of the presently preferred embodiments of the invention, such description being merely illustrative of the present invention.

BRIEF DESCRIPTION OF THE DRAWINGS

FIG. 5 represents Western blots of the CA125 repeat sequence that were generated to determine the position of the M11 epitope within the recombinant CA125 repeat. The expressed protein was bound to Ni-NTA agarose beads. The protein was left undigested or digested with Asp-N or Lys-C. The protein remaining bound to the beads was loaded into lanes 1, 2, or 3 corresponding to undigested, Asp-N digested and Lys-C digested, respectively. The supernatants from the digestions were loaded in lanes 4, 5, and 6 corresponding to undigested, Asp-N digested and Lys-C digested, respectively. The blots were probed with either anti-His tag antibody (A) or M11 antibody (B). Panel C shows a typical repeat sequence corresponding to SEQ ID NO: 150 with each exon defined by arrows. All proteolytic aspartic acid and lysine sites are marked with overhead arrow or dashes. In the lower panel, the O-glycosylation sites in exons 4 and 5 are marked with O, the N-glycosylation sites are marked with X plus the amino acid number in the repeat (#12, 33, and 49) the conserved methionine is designated with M plus the amino acid number (M#24), and the cysteine enclosure which is also present in all repeats and encompasses 19 amino acids between the cysteines is marked with C-C (amino acids #59-79). The epitopes for M11 and OC125 are located in the latter part of the C-enclosure or downstream from the C-enclosure.

FIG. 7B represents the genomic structure and exon configuration of a 156 amino acid repeat sequence of CA125 (SEQ ID NO: 163), which comprises a standard repeat unit.

FIGS. 7C, 7D, and 7E list the individual known sequences for each exon, which have been determined as follows: Exon 1—SEQ ID NOS: 164-194; Exon 2—SEQ ID NOS: 195-221;

Exon 3—SEQ ID NOS: 222-249; Exon 4—SEQ ID NOS: 250-277; and Exon 5—SEQ ID NOS: 278-298.

Figure 8A:
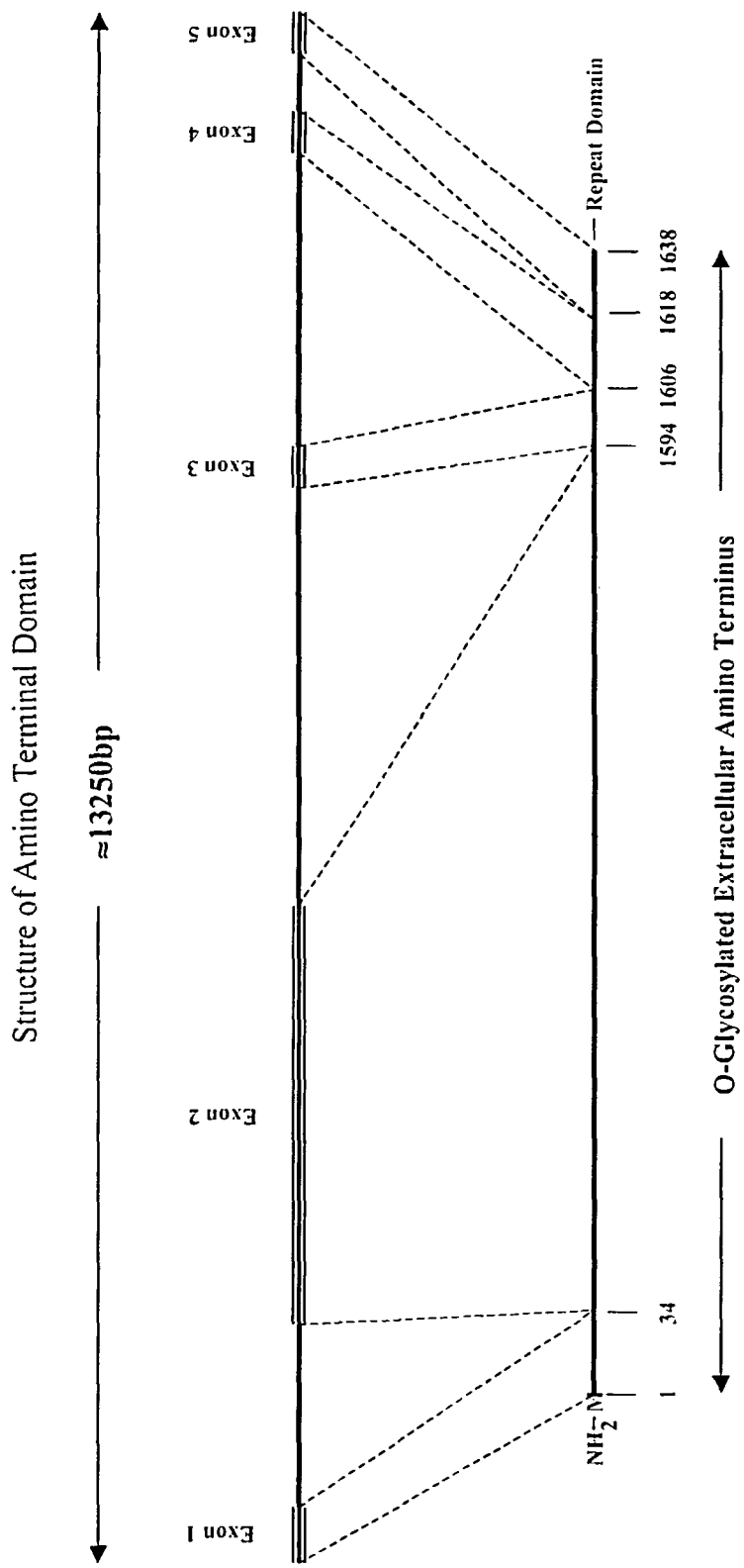

FIG. 8A shows the genomic structure of the amino terminal end of the CA125 gene. It also indicates the amino composition of each exon in the extracellular domain.

FIG. 8B illustrates the amino acid composition of the amino terminal domain (SEQ ID NO: 299) with each potential O-glycosylation site marked with a superscript (o) and N-glycosylation sites marked with a superscript (x). T-TALK sequences are underlined.

Figure 9A:
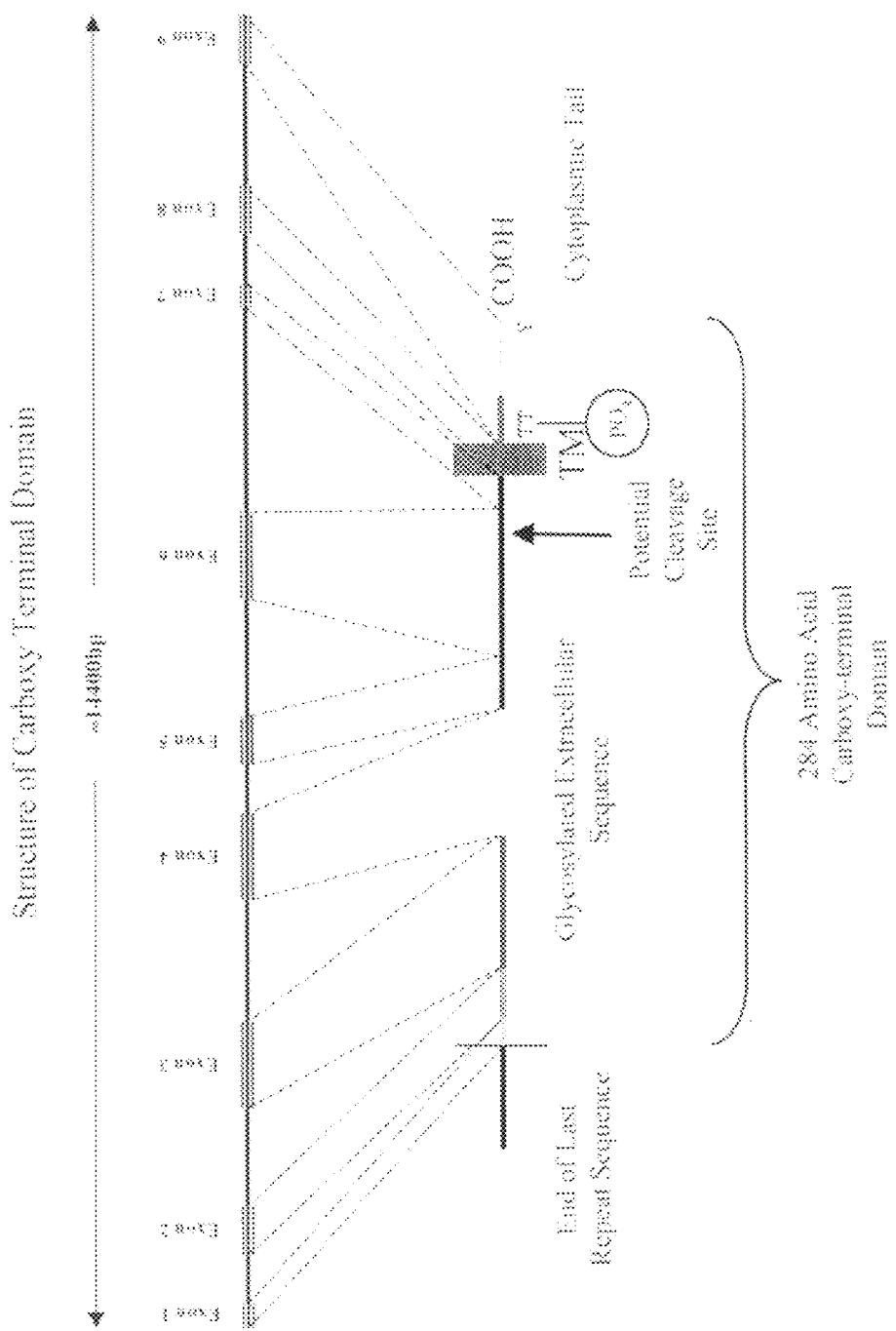

FIG. 9A illustrates the genomic exon structure of the carboxy-terminal domain of the CA125 gene. It includes a diagram showing the extracellular portion, the potential cleavage site, the transmembrane domain and the cytoplasmic tail.

FIG. 9B illustrates the amino acid composition of the carboxy terminal domain (SEQ ID NO: 300) including the exon boundaries, O-glycosylation sites (o), and N-glycosylation sites (x). The proposed transmembrane domain is underlined.

Figure 10:
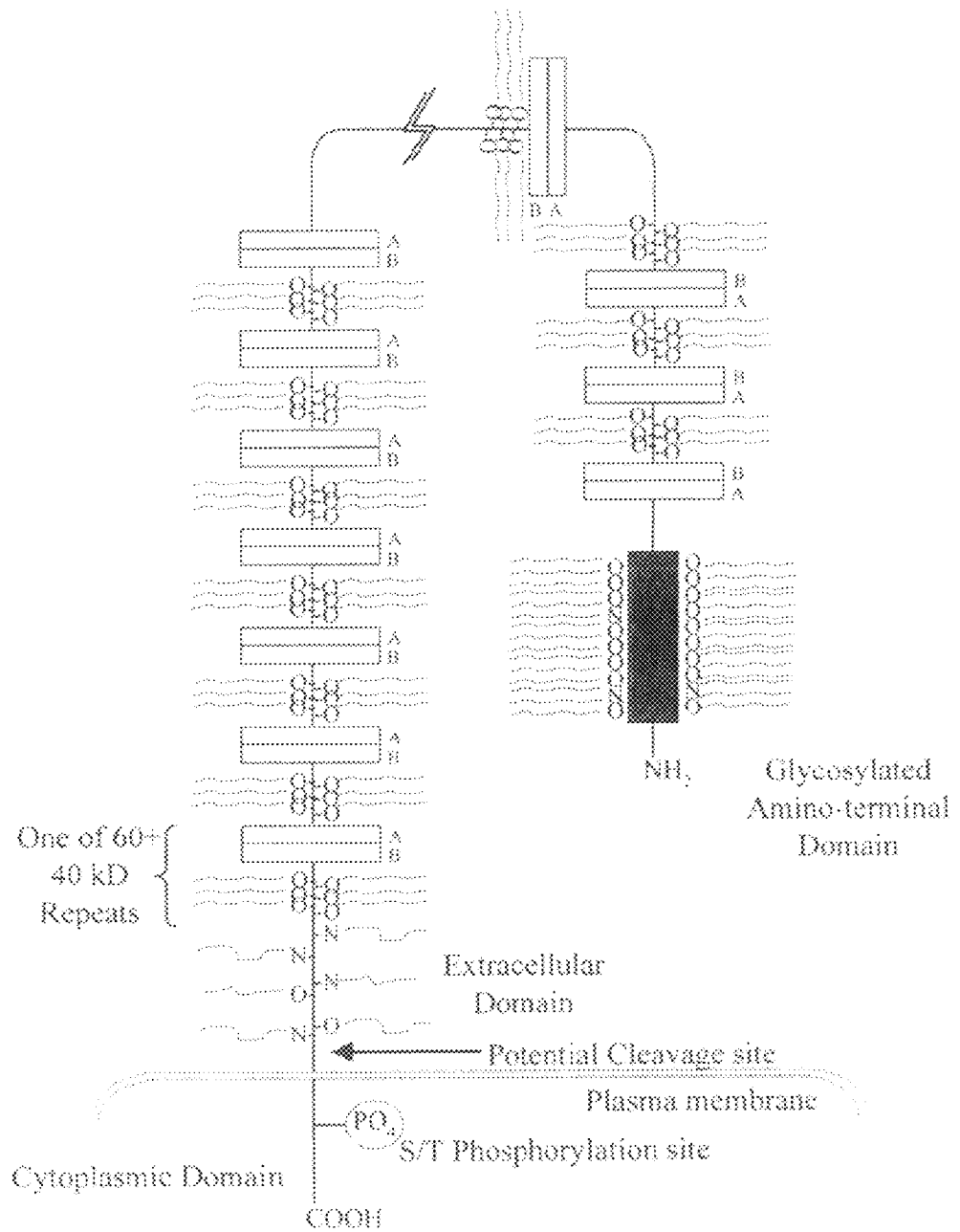

FIG. 10 illustrates the proposed structure of the CA125 molecule based on the open reading frame sequence described herein. As shown, the molecule is dominated by a major repeat domain in the extracellular space along with a highly glycosylated amino terminal repeat. The molecule is anchored by a transmembrane domain and also includes a cytoplasmic tail with potential for phosphorylation.

Figure 11:
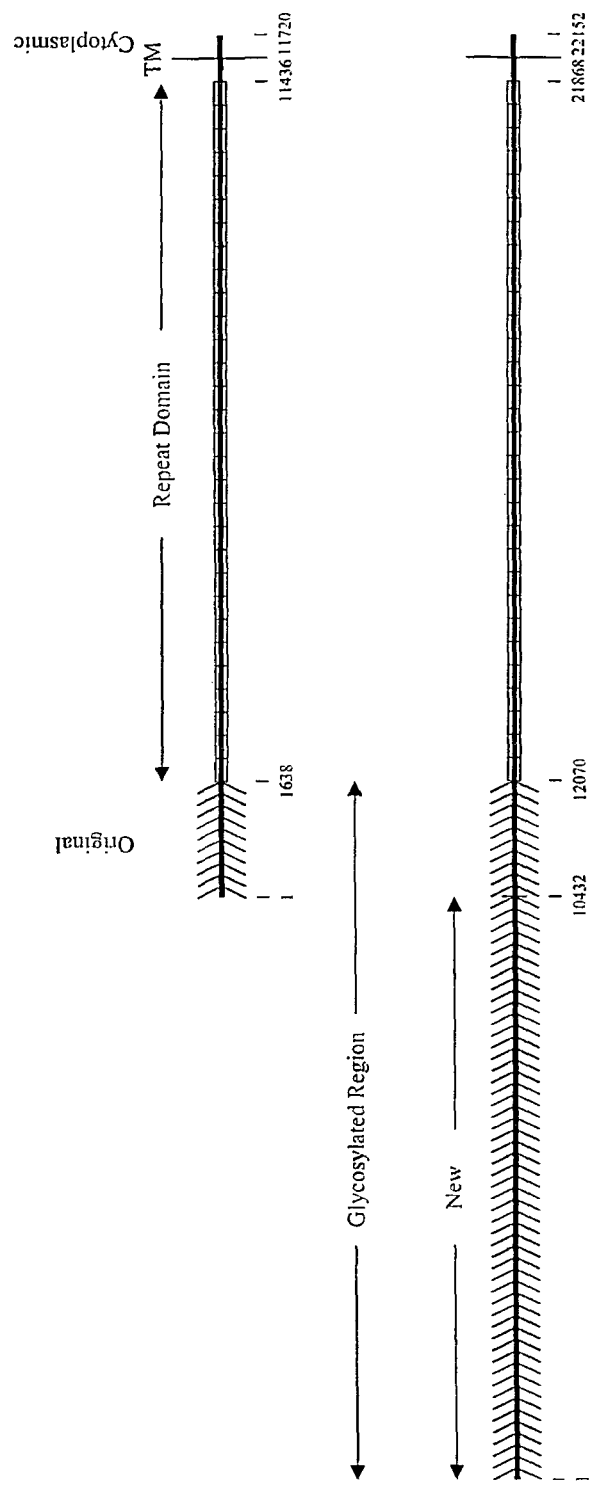

FIG. 11 is a diagram of the CA125 gene showing the originally cloned domains of both the genomic and amino acid sequences and the extension of the glycosylated amino terminal protein sequence.

Figure 12:
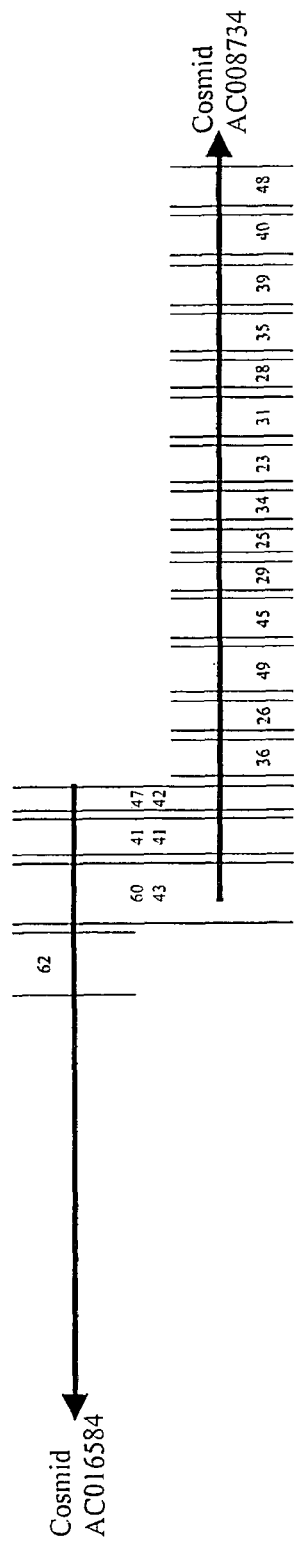

FIG. 12 is a diagram of the contig alignment from overlapping chromosome 19 cosmids.

Figure 13:
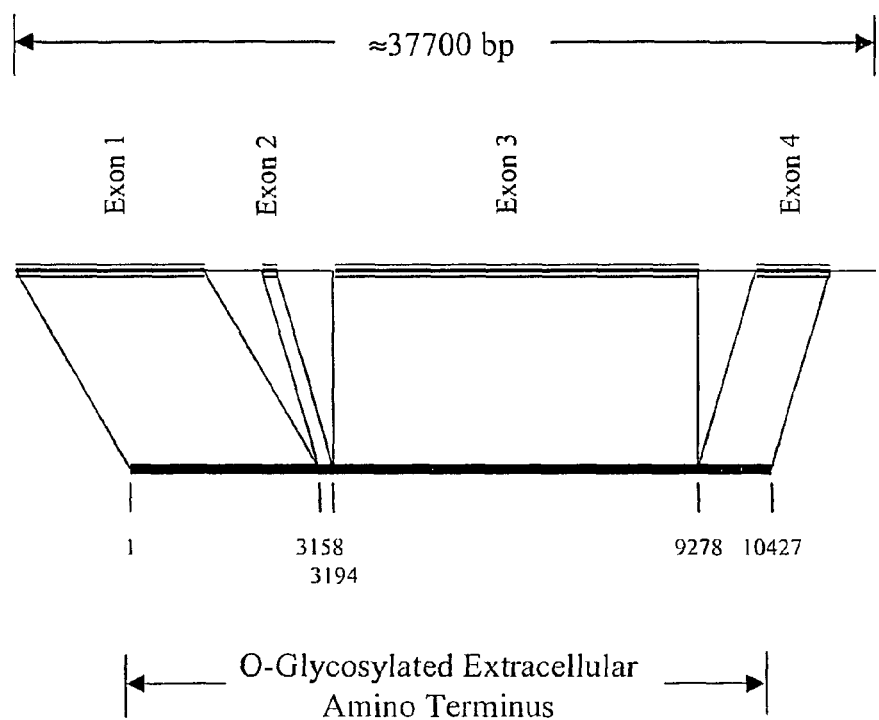

FIG. 13 illustrates the genomic exon structure of the CA125 gene amino terminal extension.

DETAILED DESCRIPTION OF THE INVENTION

In accordance with the present invention, conventional molecular biology, microbiology, and recombinant DNA techniques may be used that will be apparent to those skilled in the relevant art. Such techniques are explained fully in the literature (see, e.g., Maniatis, Fritsch & Sambrook, "Molecular Cloning: A Laboratory Manual (1982); "DNA Cloning: A Practical Approach," Volumes I and II (D. N. Glover ed. 1985); "Oligonucleotide Synthesis" (M. J. Gait ed. 1984); "Nucleic Acid Hybridization" (B. D. Hames & S. J. Higgins eds. (1985)); "Transcription and Translation" (B. D. Hames & S. J. Higgins eds. (1984)); "Animal Cell Culture" (R. I. Freshney, ed. (1986)); "Immobilized Cells And Enzymes" (IRL Press, (1986)); and B. Perbal, "A Practical Guide To Molecular Cloning" (1984)).

Therefore, if appearing herein, the following terms shall have the definitions set out below.

A "vector" is a replicon, such as plasmid, phage or cosmid, to which another DNA segment may be attached so as to bring about the replication of the attached segment.

A "DNA molecule" refers to the polymeric form of deoxyribonucletides (adenine, guanine, thymine, or cytosine) in either single stranded form, or a double-stranded helix. This term refers only to the primary and secondary structure of the molecule, and does not limit it to any particular tertiary forms. Thus, this term includes double-stranded DNA found, inter alia, in linear DNA molecules (e.g., restriction fragments), viruses, plasmids, and chromosomes.

As used herein, the term "gene" shall mean a region of DNA encoding a polypeptide chain.

"Messenger RNA" or "mRNA" shall mean an RNA molecule that encodes for one or more polypeptides.

"DNA polymerase" shall mean an enzyme which catalyzes the polymerization of deoxyribonucleotide triphosphates to make DNA chains using a DNA template.

"Reverse transcriptase" shall mean an enzyme which catalyzes the polymerization of deoxy- or ribonucleotide triphosphates to make DNA or RNA chains using an RNA or DNA template.

"Complementary DNA" or "cDNA" shall mean the DNA molecule synthesized by polymerization of deoxyribonucleotides by an enzyme with reverse transcriptase activity.

An "isolated nucleic acid" is a nucleic acid the structure of which is not identical to that of any naturally occurring nucleic acid or to that of any fragment of a naturally occurring genomic nucleic acid spanning more than three separate genes. The term therefore covers, for example, (a) a DNA which has the sequence of part of a naturally occurring genomic DNA molecule but it not flanked by both of the coding sequences that flank that part of the molecule in the genome of the organism in which it naturally occurs; (b) a nucleic acid incorporated into a vector or into the genomic DNA of a prokaryote or eukaryote in a manner such that the resulting molecule such as a cDNA, a genomic fragment, a fragment produced by polymerase chain reaction (PCR), or a restriction fragment; and (d) a recombinant nucleotide sequence that is part of a hybrid gene, i.e., a gene encoding a fusion protein.

"Oligonucleotide", as used herein a referring to the probes or primers of the present invention, is defined as a molecule comprised of two or more deoxy- or ribonucleotides, preferably more than ten. Its exact size will depend upon many factors which, in turn, depend upon the ultimate function and use of the oligonucleotide.

"DNA fragment" includes polynucleotides and/or oligonucleotides and refers to a plurality of joined nucleotide units formed from naturally-occurring bases and cyclofuranosyl groups joined by native phosphodiester bonds. This term effectively refers to naturally-occurring species or synthetic species formed from naturally-occurring subunits. "DNA fragment" also refers to purine and pyrimidine groups and moieties which function similarly but which have non naturally-occurring portions. Thus, DNA fragments may have altered sugar moieties or inter-sugar linkages. Exemplary amount these are the phosphorothioate and other sulfur containing species. They may also contain altered base units or other modifications, provided that biological activity is retained. DNA fragments may also include species which include at least some modified base forms. Thus, purines and pyrimidines other than those normally found in nature may be so employed. Similarly, modifications on the cyclofuranose portions of the nucleotide subunits may also occur as long as biological function is not eliminated by such modifications.

"Primer" shall refer to an oligonucleotide, whether occurring naturally or produced synthetically, which is capable of acting as a point of initiation of synthesis when placed under conditions in which synthesis of a primer extension product, which is complementary to a nucleic acid strand, is induced, i.e., in the presence of nucleotides and an inducing agent such as a DNA polymerase and at a suitable temperature and pH. The primer may be either single-stranded or double-stranded and must be sufficiently long to prime the synthesis of the desired extension product in the presence of the inducing agent. The exact length of the primer will depend upon many factors, including temperature, the source of primer and the method used. For example, for diagnostic applications, depending on the complexity of the target sequence, the oligonucleotide primer typically contains 10-25 or more nucleotides, although it may contain fewer nucleotides.

The primers herein are selected to be "substantially" complementary to different strands of a particular target DNA sequence. This means that the primers must be sufficiently complementary to hybridize with their respective strands. Therefore, the primer sequence need not reflect the exact sequence of the template. For example, a non-complementary nucleotide fragment may be attached to the 5' end of the primer, with the remainder of the primer sequence being complementary to the strand. Alternatively, non-complementary bases of longer sequences can be interspersed into the primer, provided that the primer sequence has sufficient complementarity with the sequence of hybridize there with and thereby form the template for the synthesis of the extension product.

As used herein, the term "hybridization" refers generally to a technique wherein denatured RNA or DNA is combined with complementary nucleic acid sequence which is either free in solution or bound to a solid phase. As recognized by one skilled in the art, complete complementarity between the two nucleic acid sequences is not a pre-requisite for hybridization to occur. The technique is ubiquitous in molecular genetics and its use centers around the identification of particular DNA or RNA sequence within complex mixtures of nucleic acids.

As used herein, "restriction endonucleases" and "restriction enzymes" shall refer to bacterial enzymes which cut double-stranded DNA at or near a specific nucleotide sequence.

"Purified polypeptide" refers to any peptide generated from CA125 either by proteolytic cleavage or chemical cleavage.

"Degenerate variant" refers to any amino acid variation in the repeat sequence, which fulfills the homology exon structure and conserved sequences and is recognized by the M11, OC125 and ISOBM series of antibodies.

"Fragment" refers to any part of the CA125 molecule identified in a purification scheme.

"Conservative variant antibody" shall mean any antibody that fulfills the criteria of M11, OC125 or any of the ISOBM antibody series.

The CA125 gene has been cloned and multiple repeat sequences as well as the carboxy terminus have been identified. The genomic DNA for the CA125 gene is set out in SEQ ID NO 311-313. The CA125 molecule comprises three major domains: an extracellular amino terminal domain (Domain 1); a large multiple repeat domain (Domain 2); and a carboxy terminal domain (Domain 3) which includes a transmembrane anchor with a short cytoplasmic domain. The amino terminal domain is assembled by combining five genomic exons, four very short amino terminal sequences and one extraordinarily large exon. This domain is dominated by its capacity for O-glycosylation and its resultant richness in serine and threonine residues. Additionally, an amino terminal extension is present, which comprises four genomic exons. The amino acid composition of the amino terminal extension was found to be consistent with the amino acid composition of the amino terminal domain. The molecular structure is dominated by a repeat domain comprising 156 amino acid repeat units, which encompass the epitope binding sites. More than 60 repeat units have been identified, sequenced, and contiguously placed in the CA125 domain structure. The repeat units encompass an interactive disulfide bridged C-enclosure and the site of OC125 and M11 binding. The repeat sequences demonstrated 70-85% homology to each other. Expression of the repeats was demonstrated in $E.$ $coli$. The CA125 molecule is anchored at its carboxy terminal through a transmembrane domain and a short cytoplasmic tail. The carboxy terminal also contains a proteolytic cleavage site approximately 50 amino acids upstream from the transmembrane domain, which allows for proteolytic cleavage and release of the CA125 molecule. Any one of the repeat domains has the potential for use as a new gold standard for detecting and monitoring the presence of the CA125 antigen. Further, the repeat domains or other domains, especially the c-terminal to the repeat domain also provide a basis for the development of a vaccine, which would be useful for the treatment of ovarian cancer and other carcinomas where CA125 is elevated.

The DNA sequences of the present invention can also be characterized as encoding the amino acid sequence equivalents of the amino acid sequence, equivalents, as used in this context, include peptides of substantially similar length and amino acid identity to those disclosed, but having conservative amino acid substitution at a non-critical residue position. A conservative amino acid substitution is a substitution in which an amino acid residue is replaced with an amino acid residue of differing identity, but whose R group can be characterized by chemically similar. Four common categories include: polor but uncharged R groups; positively charged R groups; negatively charged R groups; and, hydrophobic R groups. A preferred conservative substitution involves the substitution of a second hydrophobic residue for a fir hydrophobic residue, the first and second hydrophobic residues differing primarily in the size of the R group. The hydrophobic residue would be predicted to be located internally in the folded peptide structure and the mild pertubatim caused only by a change in the size of an R group at an internally located which would not alter the antigenecity of R protein.

The isolated cDNA sequences (Table 30 and SEQ ID NO 314) of the present invention can be inserted into an expression vector. Such vectors contain all necessary regulatory signals to promote the expression of a DNA sequence of interest. Expression vectors are typically either prokaryote or eukaryote specific. Expression vectors can be introduced into either prokaryote or eukaryote cells to produce CA125 proteins or portions thereof. This cDNA sequence was expressed to provide the CA125 molecule set out in Table 31 and SEQ ID NO 315.

MATERIALS AND METHODS

A. Tissue collection, RNA Isolation and cDNA Synthesis

Both normal and ovarian tumor tissues were utilized for cDNA preparation. Tissues were routinely collected and stored at −80° C. according to a tissue collection protocol.

Total RNA isolation was performed according to the manufacturer's instructions using the TriZol Reagent purchased from GibcoBRL (Catalog #15596-018). In some instances, mRNA was isolated using oligo dT affinity chromatography. The amount of RNA recovered was quantitated by UV spectrophotometry. First strand complementary DNA (cDNA) was synthesized using 5.0 μg of RNA and random hexamer primers according to the manufacturer's protocol utilizing a first strand synthesis kit obtained from Clontech (Catalog #K1402-1). The purity of the cDNA was evaluated by PCR using primers specific for the β-tubulin gene. These primers span an intron such that the PCR products generated from pure cDNA can be distinguished from cDNA contaminated with genomic DNA.

B. Identification and Ordering of CA125 Repeat Units

Figure 1:
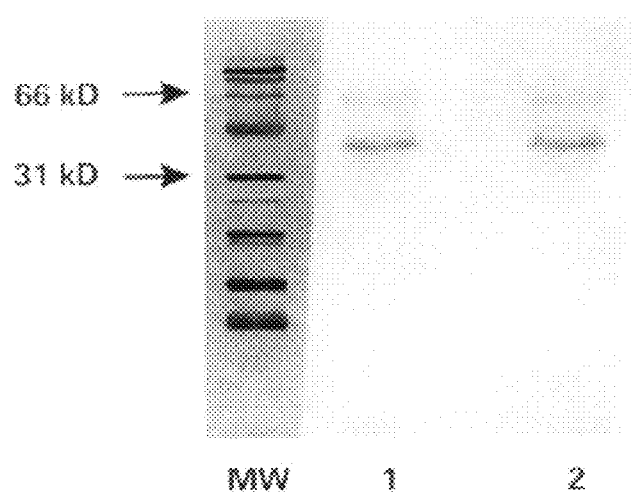
FIG. 1 illustrates the cyanogen bromide digested products of CA125 on Western blot probed with M11 and OC125 antibodies. Table 1 shows the amino acid sequence derived from the amino terminal end of the 40 kDa cyanogen bromide peptide along with internal sequences obtained after protease digestion of the 40 kDa fragment (SEQ ID NOS: 1-4). SEQ ID NO: 1 is the amino terminal sequence derived of the 40 kDa peptide and SEQ ID NOS: 2, 3, and 4 reflect internal amino acid sequences derived from peptides after protease digestion of the 40 kDa fragment. Table 1 further provides a translation of the EST (BE005912) with homologous sequences (SEQ ID NOS: 5 and 6) either boxed or underlined. Protease cleavage sites are indicated by arrows.

It has been demonstrated that the 2-5 million dalton CA125 glycoprotein (with repeat domains) can be chemically segmented into glycopeptide fragments using cyanogen bromide. As shown in FIG. 1, several of these fragments, in particular the 40 kDa and 60 kDa fragments, still bind to the to the two classical antibody groups defined by OC125 and M11.

To convert CA125 into a consistent glycopeptide, the CA125 parent molecule was processed by cyanogen bromide digestion. This cleavage process resulted in two main fractions on commassie blue staining following polyacrylamide gel electrophoresis. An approximately 60 kDa band and a more dominant 40 kDa band were identified as shown in FIG. 1. When a Western blot of these bands was probed with either OC125 or M11 antibodies (both of which define the CA125 molecule), these bands bound both antibodies. The 40 kDa band was significantly more prominent than the 60 kDa band. These data thus established the likelihood of these bands (most especially the 40 kDa band) as being an authentic cleavage peptide of the CA125 molecule, which retained the identifying characteristic of OC125 and M11 binding.

The 40 kDa and 60 kDa bands were excised from PVDF blots and submitted to amino terminal and internal peptide amino acid sequencing as described and practiced by Harvard Sequencing, (Harvard Microchemistry Facility and The Biological Laboratories, 16 Divinity Avenue, Cambridge, Mass. 02138). Sequencing was successful only for the 40 kDa band where both amino terminal sequences and some internal sequences were obtained as shown in Table 1 at SEQ ID NOS: 1-4. The 40 kDa fragment of the CA125 protein was found to have homology to two translated EST sequences (GenBank Accession Nos. BE005912 and AA640762). Visual examination of these translated sequences revealed similar amino acid regions, indicating a possible repetitive domain. The nucleotide and amino acid sequences for EST Genbank Accession No. BE005912 (corresponding to SEQ ID NO: 5 and SEQ ID NO: 6, respectively) are illustrated in Table 1. Common sequences are boxed or underlined.

In an attempt to identify other individual members of this proposed repeat family, two oligonucleotide primers were synthesized based upon regions of homology in these EST sequences. Shown in Table 2A, the primer sequences correspond to SEQ ID NOS: 7 and 8 (sense primers) and SEQ ID NOS: 9 and 10 (antisense primers). Repeat sequences were amplified in accordance with the methods disclosed in the following references: Shigemasa K et al., p21: A monitor of p53 dysfunction in ovarian neoplasia, *Int. J Gynecol. Cancer* 7:296-303 (1997) and Shigemasa K et al., p 16 Overexpression: A potential early indicator of transformation in ovarian carcinoma, *J Soc. Gynecol. Invest.* 4:95-102 (1997). Ovarian tumor cDNA obtained from a tumor cDNA bank was used.

Amplification was accomplished in a Thermal Cycler (Perkin-Elmer Cetus). The reaction mixture consisted of 1U Taq DNA Polymerase in storage buffer A (Promega), 1× Thermophilic DNA Polymerase 10×Mg free buffer (Promega), 300 mM dNTPs, 2.5 mM MgCl2, and 0.25 mM each of the sense and antisense primers for the target gene. A 20 µl reaction included 1 µl of cDNA synthesized from 50 ng of mMRNA from serous tumor mRNA as the template. PCR reactions required an initial denaturation step at 94° C./1.5 min. followed by 35 cycles of 94° C./0.5 min., 48° C./0.5 min., 72° C./0.5 min. with a final extension at 72° C./7 min. Three bands were initially identified (>>400 bp, >>800 bp, and >>1200 bp) and isolated. After size analysis by agarose gel electrophoresis, these bands as well as any other products of interest were then ligated into a T-vector plasmid (Promega) and transformed into competent DH5α strain of *E. coli* cells. After growth on selective media, individual colonies were cultured overnight at 37° C., and plasmid DNA was extracted using the QIAprep Spin Miniprep kit (Qiagen). Positive clones were identified by restriction digests using Apa I and Sac I. Inserts were sequenced using an ABI automatic sequencer, Model 377, T7 primers, and a Big Dye Terminator Cycle Sequencing Kit (Applied Biosystems).

Obtained sequences were analyzed using the Pileup program of the Wisconsin Genetic's Computer Group (GCG). Repeat units were ordered using primers designed against two highly conserved regions within the nucleotide sequence of these identified repeat units. Shown in Table 2B, the sense and antisense primers (5'-GTCTCTATGTCAATG-GTTTCACCC-3'/5'-TAGCTGCTCTCTGTCCAGTCC-3' SEQ ID NOS: 301 and 302, respectively) faced away from one another within any one repeat creating an overlap sequence, thus enabling amplification across the junction of any two repeat units. PCR reactions, cloning, sequencing, and analysis were performed as described above.

C. Identification and Assembly of the CA125 Amino Terminal Domain

In search of open reading frames containing sequences in addition to CA125 repeat units, database searches were performed using the BLAST program available at the National Center for Biotechnology Information (www.ncbi.nlm.nih.gov/). Using a repeat unit as the query sequence, cosmid AC008734 was identified as having multiple repeat sequences throughout the unordered (35) contiguous pieces of DNA, also known as contigs. One of these contigs, #32, was found to have exons 1 and 2 of a repeat region at its 3' end. Contig#32 was also found to contain a large open reading frame (ORF) upstream of the repeat sequence. PCR was again used to verify the existence of this ORF and confirm its connection to the repeat sequence. The specific primers recognized the 3' end of this ORF (5'-CAGCAGAGACCAG-CACGAGTACTC-3')(SEQ ID NO: 51) and sequence within the repeat (5'-TCCACTGCCATGGCTGAGCT-3')(SEQ ID NO: 52). The remainder of the amino-terminal domain was assembled from this contig in a similar manner. With each PCR confirmation, a new primer (see Table 10A) was designed against the assembled sequence and used in combination with a primer designed against another upstream potential ORF (Set 1: 5'-CCAGCACAGCTCTTCCCAG-GAC-3'/5'-GGAATGGCTGAGCTGACGTCTG-3'(SEQ ID NO: 53 and SEQ ID NO: 54); Set 2: 5'-CTTCCCAGGA-CAACCTCAAGG-3'/5'-GCAGGATGAGTGAGC-CACGTG-3'(SEQ ID NO: 55 and SEQ ID NO: 56); Set 3: 5'-GTCAGATCTGGTGACCTCACTG-3'/5'-GAG-GCACTGGAAAGCCCAGAG-3')(SEQ ID NO: 57 and SEQ ID NO: 58). Potential adjoining sequence (contig #7 containing EST AU133673) was also identified using contig #32 sequence as query sequence in database searches. Confirmation primers were designed and used in a typical manner (5'-CTGATGGCATTATGGAACACATCAC-3'/5'-CCCA-GAACGAGAGACCAGTGAG-3')(SEQ ID NO: 59 and SEQ ID NO: 60).

In order to identify the 5' end of the CA125 sequence, 5' Rapid Amplification of cDNA Ends (FirstChoice™ RLM-RACE Kit, Ambion) was performed using tumor cDNA. The primary PCR reaction used a sense primer supplied by Ambion (5'-GCTGATGGCGATGAATGAACACTG-3') (SEQ ID NO: 61) and an anti-sense primer specific to confirmed contig #32 sequence (5'-CCCAGAACGAGAGAC-CAGTGAG-3') (SEQ ID NO: 62). The secondary PCR was then performed using nested primers, sense from Ambion (5'-CGCGGATCCGAACACTGCGTTTGCTG-GCTTTGATG-3') (SEQ ID NO: 63) and the anti-sense was specific to confirmed contig #7 sequence (5'-CCTCTGTGT-GCTGCTTCATTGGG-3')(SEQ ID NO: 64). The RACE PCR product (a band of approximately 300 bp) was cloned and sequenced as previously described.

D. Identification and Assembly of the CA125 Carboxy Terminal Domain

Database searches using confirmed repeat units as query also identified a cDNA sequence (GenBank AK024365) containing other repeat units, but also a potential carboxy terminal sequence. The contiguous nature of this sequence with assembled CA125 was confirmed using PCR (5'-GGA-CAAGGTCACCACACTCTAC-3'/5'-GCAGATCCTCCAG-GTCTAGGTGTG-3'), (SEQ ID NO: 303 and SEQ ID NO: 304, respectively) as well as contig and EST analysis.

E. Expression of 6×His-tagged CA125 repeat in *E. coli*

The open reading frame of a CA125 repeat shown in Table 11 was amplified by PCR with the sense primer (5'-ACCG-GATCCATGGGCCACACAGAGCCTGGCCC-3') (SEQ ID NO: 65) the antisense primer (5'-TGTAAGCTTAGGCAGG-GAGGATGGAGTCC-3') (SEQ ID NO: 66) PCR was performed in a reaction mixture consisting of ovarian tumor cDNA derived from 50 ng of mRNA, 5 pmol each of sense and antisense primers for the CA125 repeat, 0.2 mmol of dNTPs, and 0.625 U of Taq polymerase in 1× buffer in a final volume of 25 ml. This mixture was subjected to 1 minute of denaturation at 95° C. followed by 30 cycles of PCR consisting of the following: denaturation for 30 seconds at 95° C., 30 seconds of annealing at 62° C., and 1 minute of extension at 72° C. with an additional 7 minutes of extension on the last cycle. The product was electrophoresed through a 2% agarose gel for separation. The PCR product was purified and digested with the restriction enzymes Bam HI and Hind III. This digested PCR product was then ligated into the expression vector pQE-30, which had also been digested with Bam HI and Hind III. This clone would allow for expression of recombinant 6×His-tagged CA125 repeat. Transformed *E. coli* (JM109) were grown to an OD600 of 1.5-2.0 at 37° C. and then induced with IPTG (0.1 mM) for 4-6 hours at 25° C. to produce recombinant protein. Whole *E. coli* lysate was electrophoresed through a 12% SDS polyacrylamide gel and Coomassie stained to detect highly expressed proteins.

F. Western Blot Analysis

Proteins were separated on a 12% SDS-PAGE gel and electroblotted at 100V for 40 minutes at 4° C. to nitrocellulose membrane. Blots were blocked overnight in phosphate-buffered saline (PBS) pH 7.3 containing 5% non-fat milk. CA125 antibodies M11, OC125, or ISOBM 9.2 were incubated for 2 hours at room temperature. The blot was washed for 30 minutes with several changes of PBS and incubated with a 1:10,000 dilution of horseradish perioxidase (HRP) conjugated goat anti-mouse IgG antibody (Bio-Rad) for 1 hour at room temperature. Blots were washed for 30 minutes with several changes of PBS and incubated with a chemiluminescent substrate (ECL from Amersham Pharmacia Biotech) before a 10-second exposure to X-ray film for visualization.

Figure 4:
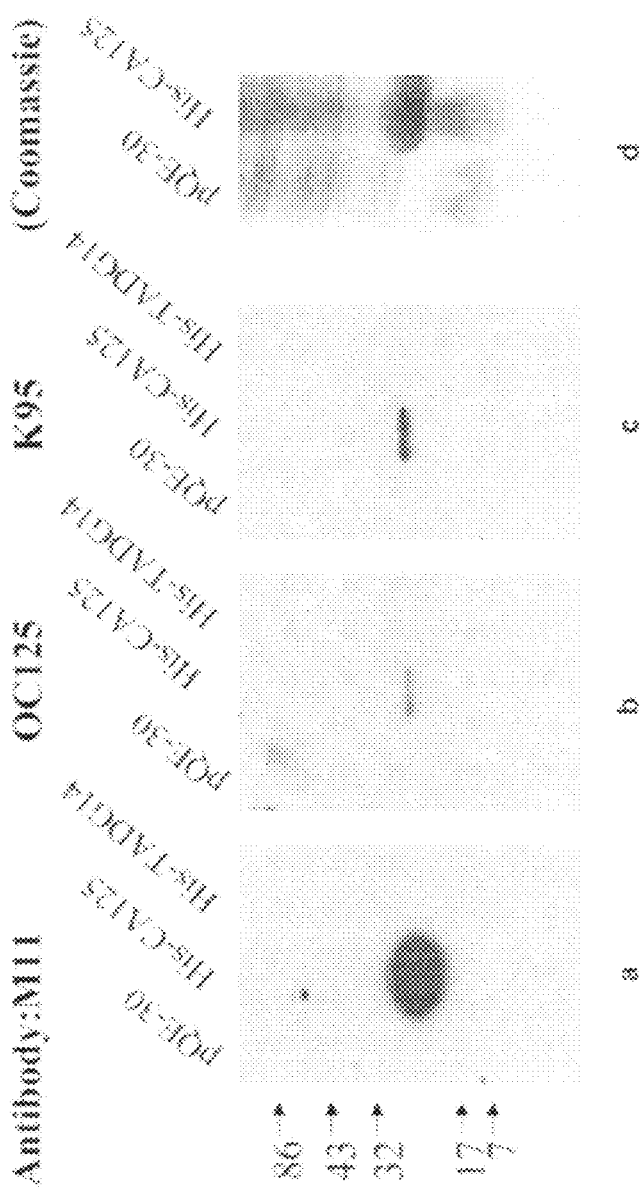
FIG. 4 illustrates three Western immunoblot patterns: Panel A=probed with M11, Panel B=probed with OC125 and Panel C=probed with antibody ISOBM 9.2. Each panel represents *E. coli* extracts as follows: lane 1=*E. coli* extract from bacteria with the plasmid PQE-30 only. Lane 2=*E. coli* extract from bacteria with the plasmid PQE-30 which includes the CA125 repeat unit. Lane 3=*E. coli* extract from bacteria with the plasmid PQE-30 which includes the TADG-14 protease unrelated to CA125. Panel D shows a Coomassie blue stain of a PAGE gel of *E. coli* extract derived from either PQE-30 alone or from bacteria infected with PQE-30-CA125 repeat (recombinant CA125 repeat).

FIG. 4 illustrates three Western immunoblot patterns of the recombinant CA125 repeat purified from *E. coli* lysate (lane 2) compared to *E. coli* lysate with no recombinant protein (lane 1-negative control) and a recombinant protein TADG-14 which is unrelated to CA125 (lane 3). As shown, the M11 antibody, the OC125 antibody and the antibody ISOBM 9.2 (an OC125-like antibody) all recognized the CA125 recombinant repeat (lane 2), but did not recognize either the *E. coli* lysate (lane 1) or the unrelated TADG-14 recombinant (lane 3). These data confirm that the recombinant repeat encodes both independent epitopes for CA125, the OC125 epitope and the M11 epitope.

G. Northern Blot Analysis

Total RNA samples (approximately 10 μg) were separated by electrophoresis through a 6.3% formaldehyde, 1.2% agarose gel in 0.02 M MOPS, 0.05 M sodium acetate (pH 7.0), and 0.001 M EDTA. The RNAs were then blotted to Hybond-N (Amersham) by capillary action in 20×SSPE and fixed to the membrane by baking for 2 hours at 80° C. A PCR product representing one 400 bp repeat of the CA125 molecule was radiolabelled using the Prime-a-Gene Labeling System available from Promega (cat. #U1100). The blot was probed and stripped according to the ExpressHyb Hybridization Solution protocol available from Clontech (Catalog #8015-1).

RESULTS

In 1997, a system was described by a co-inventor of the present invention and others for purification of CA125 (primarily from patient ascites fluid), which when followed by cyanogen bromide digestion, resulted in peptide fragments of CA125 of 60 kDa and 40 kDa [O'Brien T J et al., More than 15 years of CA125: What is known about the antigen, its structure and its function, *Int J Biological Markers* 13(4)188-195 (1998)]. Both fragments were identifiable by commassie blue staining on polyacrylamide gels and by Western blot. Both fragments were shown to bind both OC125 and M11 antibodies, indicating both major classes of epitopes were preserved in the released peptides (FIG. 1).

Figure 2:
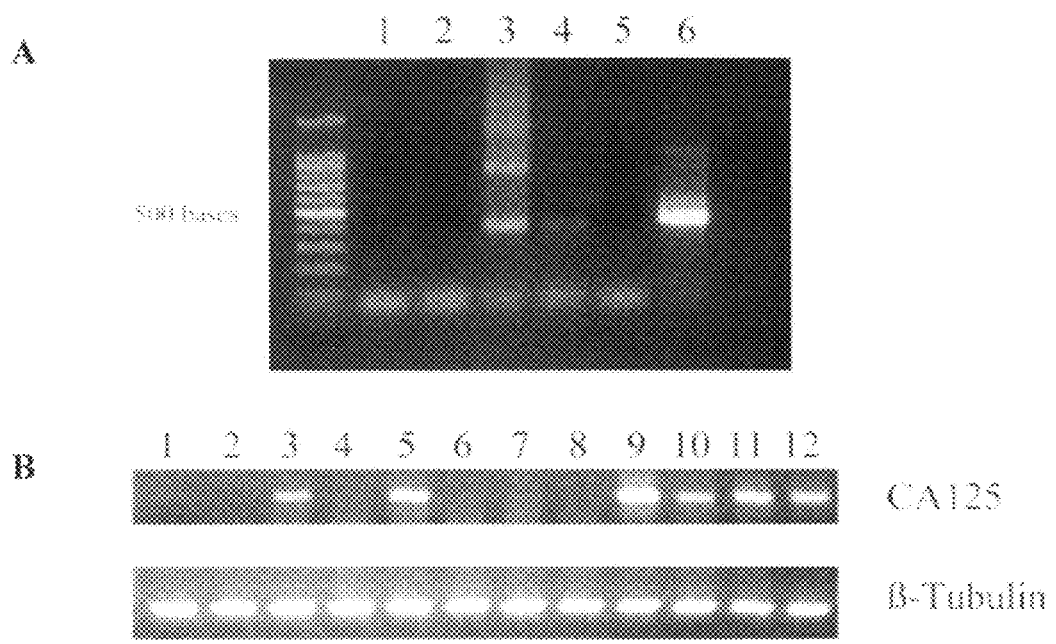
FIG. 2A illustrates PCR amplification of products generated from primers utilizing the EST sequence referred to in FIG. 1, the amino acid sequence obtained from the 40 kDa fragment and EST sequence AA#640762. Lane 1-2: normal; 3: serous ovarian carcinoma; 4: serous ovarian carcinoma; 5: mucinous ovarian carcinoma; 6: β-tubulin control. The anticipated size band 400 b is present in lane 3 and less abundantly in lane 4.
FIG. 2B illustrates the RT-PCR that was performed to determine the presence or absence of CA125 transcripts in primary culture cells of ovarian tumors. This expression was compared to tubulin expression as an internal control. Lanes 1, 3, 5, 7, and 9 represent the primary ovarian tumor cell lines. Lanes 2, 4, 6, and 8 represent peripheral blood mononuclear cell lines derived from the corresponding patients in lanes 1, 3, 5, and 7. Lane 10 represents fibroblasts from the patient tumor in lane 9. Lanes 11 and 12 are CaOV3 and a primary tumor specimen, respectively.

Protein sequencing of the 40 kDa band yielded both amino terminal sequences and some internal sequences generated by protease digestion (Table 1—SEQ ID NOS: 1-4). Insufficient yields of the 60 kDa band resulted in unreliable sequence information. Unfortunately, efforts to amplify PCR products utilizing redundant primers designed to these sequences were not successful. In mid 2000, an EST (#BE005912) was entered into the GCG database, which contained homology to the 40 kDa band sequence as shown in Table 1 (SEQ ID NOS: 5 and 6). The translation of this EST indicated good homology to the amino terminal sequence of the 40 kDa repeat (e.g. residues 2-12 of SEQ ID NO:6) with only one amino acid difference (i.e. an asparagine is present instead of phenylalanine in the EST sequence). Also, some of the internal sequences are partially conserved (e.g. SEQ ID NO: 2 and to a lesser extent, SEQ ID NO: 3 and SEQ ID NO: 4). More importantly, all the internal sequences are preceded by a basic amino acid (Table 1, indicated by arrows) appropriate for proteolysis by the trypsin used to create the internal peptides from the 40 kDa cyanogen bromide repeat. Utilizing the combined sequences, those obtained by amino acid sequencing and those identified in the EST (#BE005912) and a second EST (#AA640762) identified in the database, sense primers were created as follows: 5'-GGA GAG GGT TCT GCA GGG TC-3' (SEQ ID NO: 7) representing amino acids ERVLQG (SEQ ID NO: 8) and anti-sense primer, 5' GTG AAT GGT ATC AGG AGA GG-3' (SEQ ID NO: 9) representing PLLIPF (SEQ ID NO: 10). Using PCR, the presence of transcripts was confirmed representing these sequences in ovarian tumors and their absence in normal ovary and either very low levels or no detectable levels in a mucinous tumor (FIG. 2A). The existence of transcripts was further confirmed in cDNA derived from multiple primary ovarian carcinoma cell lines and the absence of transcripts in matched lymphocyte cultures from the same patient (FIG. 2B).

After cloning and sequencing of the amplified 400 base pair PCR products, a series of sequences were identified, which had high homology to each other but which were clearly distinct repeat entities (FIG. 3) (SEQ ID NOS: 158 through 161).

Examples of each category of repeats were sequenced, and the results are shown in Tables 3, 4, and 5. The sequences represent amplification and sequence data of PCR products obtained using oligonucleotide primers derived from an EST (Genbank Accession No. BE005912). Table 3 illustrates the amino acid sequence for a 400 bp repeat in the CA125 molecule, which is identified as SEQ ID NO: 11 through SEQ ID NO: 21. Table 4 illustrates the amino acid sequence for a 800 bp repeat in the CA125 molecule, which corresponds to SEQ ID NO: 22 through SEQ ID NO: 35. Table 5 illustrates the amino acid sequence for a 1200 bp repeat in the CA125 molecule, which is identified as SEQ ID NO: 36 through SEQ ID NO: 46. Assembly of these repeat sequences (which showed 75-80% homology to each other as determined by GCG Software (GCG=Genetics Computer Group) using the Pileup application) utilizing PCR amplification and sequencing of overlapping sequences allowed for the construction of a 9 repeat structure. The amino acid sequence for the 9 repeat is shown in Table 6 as SEQ ID NO: 47. The individual C-enclosures are highlighted in the table.

Using the assembled repeat sequence in Table 6 to search genebank databases, a cDNA sequence referred to as Genbank Accession No. AK024365 (entered on Sep. 29, 2000) was discovered. Table 7 shows the amino acid sequence for AK024365, which corresponds to SEQ ID NO: 48. AK024365 was found to overlap with two repeats of the assembled repeat sequence shown in Table 6. Individual C-enclosures are highlighted in Table 7.

Figure 6:
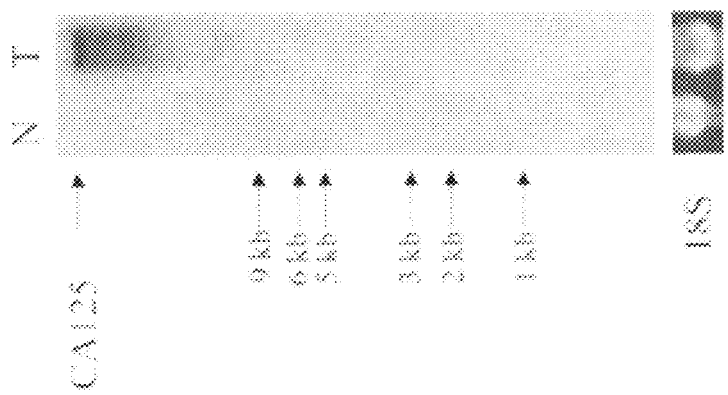
FIG. 6 illustrates a Northern blot analysis of RNA derived from either normal ovary (N) or ovarian carcinoma (T) probed with a $P^{32}$ cDNA repeat sequence of CA125. Total RNA samples (10 μg) were size separated by electrophoresis on a formaldehyde 1.2% agarose gel. After blotting to Hybond N, the lanes were probed with $P^{32}$ radiolabelled 400 bp repeat (see FIG. 2). Lane 1 represents RNA from normal ovarian tissue, and lane 2 represents RNA from serous ovarian tumor tissue.
Figure 7A:
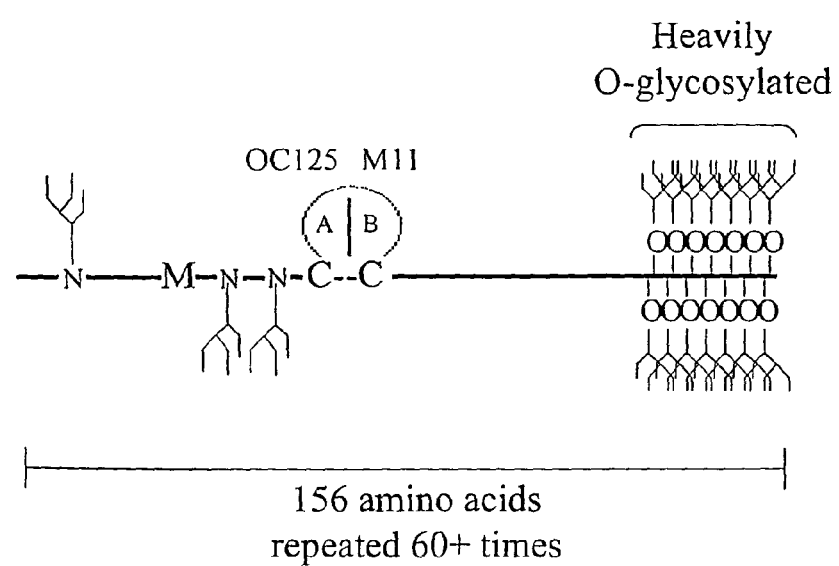
FIG. 7A is a schematic diagram of a typical repeat unit for CA125 showing the N-glycosylation sites at the amino end and the totally conserved methionine (M). Also shown is the proposed cysteine enclosed loop with antibody binding sites for OC125 and M11. Also noted are the highly O-glycosylated residues at the carboxy end of the repeat.

The cDNA for AK024365 allowed alignment of four additional repeats as well as a downstream carboxy terminus sequence of the CA125 gene. Table 8 illustrates the complete DNA sequence of 13 repeats contiguous with the carboxy terminus of the CA125 molecule, which corresponds to SEQ ID NO: 49. Table 9 illustrates the complete amino acid sequence of the 13 repeats and the carboxy terminus of the CA125 molecule, which corresponds to SEQ ID NO: 50. The carboxy terminus domain was further confirmed by the existence of two EST's (Genbank Accession Nos. AW150602 and AI923224) in the genebank database, both of which confirmed the stop-codon indicated (TGA) as well as the poly A signal sequence (AATAA) and the poly A tail (see Table 9). The presence of these repeats has been confirmed in serous ovarian tumors and their absence in normal ovarian tissue and mucinous tumors as expected (see FIG. 2A). Also, the transcripts for these repeats have been shown to be present in tumor cell lines derived from ovarian tumors, but not in normal lymphocyte cell lines (FIG. 2B). Moreover, Northern blot analysis of mRNA derived from normal or ovarian carcinoma and probed with a $P^{32}$ labeled CA125 repeat sequence (as shown in FIG. 6) confirmed the presence of an RNA transcript in excess of 20 kb in ovarian tumor extracts (see FIG. 2B).

Figure 3:
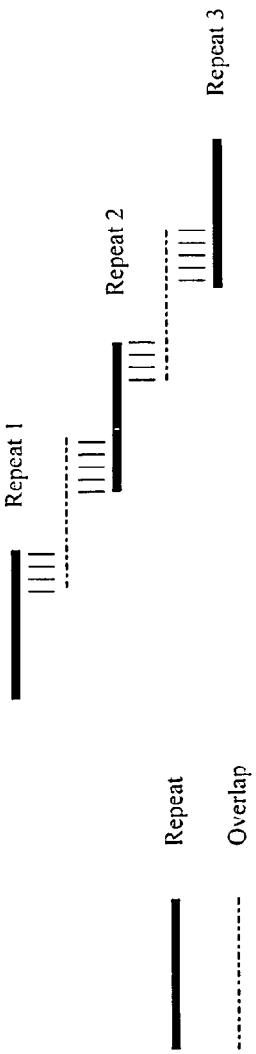
FIG. 3 illustrates repeat sequences determined by sequencing cloned cDNA from the 400 b band in FIG. 2B. Placing of repeat sequences in a contiguous fashion was accomplished by PCR amplification and sequencing of overlap areas between two repeat sequences. A sample of the complete repeat sequences is shown in SEQ ID NOS: 158, 159, 160, and 161, which was obtained in this manner and placed next to each other based on overlap sequences. The complete list of repeat sequences that was obtained is shown in Table 21 (SEQ ID NO: 162).

To date, 45 repeat sequences have been identified with high homology to each other. To order these repeat units, overlapping sequences were amplified using a sense primer (5' GTC TCT ATG TCA ATG GTT TCA CCC-3') (SEQ ID NO: 305) from an upstream repeat and an antisense primer from a downstream repeat sequence (antisense 5' TAG CTG CTC TCT GTC CAG TCC-3') (SEQ ID NO: 306). Attempts have been made to place these repeats in a contiguous fashion as shown in FIG. 3. There is some potential redundancy. Further, there is evidence from overlapping sequences that some repeats exist in more than one location in the sequence giving a total of more than 60 repeats in the CA125 molecule (see Table 21 SEQ ID NO: 162).

Final confirmation of the relationship of the putative CA125 repeat domain to the known CA125 molecule was achieved by expressing a recombinant repeat domain in *E. coli*. In FIG. 4, expression of a recombinant CA125 repeat domain is shown in lane 2 compared to the vector alone in lane 1, Panel D. A series of Western blots representing *E. coli* extracts of vector alone in lane 1; CA125 recombinant protein lane in 2 and recombinant TADG-14 (an unrelated recombinant protease), lane 3, were probed with the CA125 antibodies M11, Panel A; OC125, Panel B; and ISOBM 9.2, Panel C. In all cases, CA125 antibodies recognized only the recombinant CA125 antigen (lane 2 of each panel).

To further characterize the epitope location of the CA125 antibodies, recombinant CA125 repeat was digested with the endoprotease Lys-C and separately with the protease Asp-N. In both cases, epitope recognition was destroyed. As shown in FIG. 5, the initial cleavage site for ASP-N is at amino acid #76 (indicated by arrow in FIG. 5C). This sequence (amino acids #1-76), a 17 kDa band, was detected with anti-histidine antibodies (FIG. 5A, Lane 3) and found to have no capacity to bind CA125 antibodies (FIG. 5B, Lane 3). The upper bands in FIGS. 5A and 5B represent the undigested remaining portion of the CA125 recombinant repeat. From these data, one can reasonably conclude that epitopes are either located at the site of cleavage and are destroyed by Asp-N or are downstream from this site and also destroyed by cleavage. Likewise, cleavage with Lys-C would result in a peptide, which includes amino acids #68-154 (FIG. 5C) and again, no antibody binding was detected. In view of the foregoing, it seems likely that epitope binding resides in the cysteine loop region containing a possible disulfide bridge (amino acids #59-79). Final confirmation of epitope sites are being examined by mutating individual amino acids.

To determine transcript size of the CA125 molecule, Northern blot analysis was performed on MRNA extracts from both normal and tumor tissues. In agreement with the notion that CA125 may be represented by an unusually large transcript due to its known mega dalton size in tumor sera, ascites fluid, and peritoneal fluid [Nustad K et al., CA125— epitopes and molecular size, *Int. J of Biolog.* Markers, 13(4) 196-199 (1998)], a transcript was discovered which barely entered the gel from the holding well (FIG. 6). CA125 mRNA was only present in the tumor RNA sample and while a precise designation of its true size remains difficult due to the lack of appropriate standards, its unusually large size would accommodate a protein core structure in excess of 11,000 amino acids.

Evidence demonstrates that the repeat domain of the CA125 molecule encompasses a minimum of 45 different 156 amino acid repeat units and possibly greater than 60 repeats, as individual repeats occur more than once in the sequence. This finding may well account for the extraordinary size of the observed transcript. The amino acid composition of the repeat units (FIGS. 7A, 7C-E, Table 21) indicates that the sequence is rich in serine, threonine, and proline typical of the high STP repeat regions of the mucin genes [Gum Jr., JR, Mucin genes and the proteins they encode: Structure, diversity and regulation, *Am J Respir. Cell Mol. Biol.* 7:557-564 (1992)]. Results suggest that the downstream end of the repeat is heavily glycosylated.

Also noteworthy is a totally conserved methionine at position 24 of the repeat (FIGS. 7A, 7C-E,). It is this methionine which allowed cyanogen bromide digestion of the CA125 molecule, resulting in the 40 kDa glycopeptide that was identified with OC125 and M11 antibodies in Western blots of the CNBr digested peptides. These data predict that the epitopes for the CA125 antibodies are located in the repeat sequence. By production of a recombinant product representing the repeat sequence, results have confirmed this to be true. A potential disulfide bond is noted, which would encompass a C-enclosure comprising 19 amino acids enclosed by two cysteines at positions #59 and #79. The cysteines are totally conserved, which suggest a biological role for the resulting putative C-enclosure in each repeat. As mentioned above, it is likely that the OC125 and M11 epitopes are located in the C-enclosure, indicating its relative availability for immune detection. This is probably due to the C-enclosure structure and the paucity of glycosylation in the immediate surrounding areas. Domain searches also suggest some homology in the repeat domain to an SEA domain commonly found in the mucin genes [Williams S J et al., MUC13, a novel human cell surface mucin expressed by epithelial and hemopoietic cells, J of Biol. Chem 276(21)18327-18336 (2001)] beginning at amino acid #1 and ending at #131 of each repeat. No biological function has been described for this domain.

Based on homology of the repeat sequences to chromosome 19q 13.2 (cosmid #AC008734) and confirmed by genomic amplification, it has been established that each repeat is comprised of 5 exons (covering approximately 1900 bases of genomic DNA): exon 1 comprises 42-amino acids (#1-42); exon 2 comprises 23 amino acids (#43-65); exon 3 comprises 58 amino acids (#66-123); exon 4 comprises 12 amino acids (#124-135); and exon 5 comprises 21 amino acids (#136-156) (see FIG. 7B). Homology pile-ups of individual exons have also been completed (see FIGS. 7C-7E), which indicates that exon 1 has a minimum of 3 different copies of the exon; exon 2 has 27 copies; exon 3 has 28 copies, exon 4 has 28 copies and exon 5 has 21 copies. If all exons were only found in a single configuration relative to each other, one could determine that a minimum number of repeats of 31 were present in the CA125 molecule. Using the exon 2 pile-up data as an example, it has been established as mentioned above that there are 27 individual exon 2 sequences. Using exon 2, which was sequenced fully in both the repeat units and the overlaps, results established that a minimum of 45 repeat units are present when exon 2 is combined with unique other exon combinations. However, based on overlap sequence information, 60+ repeat units are likely present in the CA125 molecule (Table 21). This larger number of repeat units can be accounted for by the presence of the same repeat unit occurring in more than one location.

Currently, the repetitive units of the repeat domain of the CA125 molecule constitute the majority of its extracellular molecular structure. These sequences have been presented in a tandem fashion based on overlap sequencing data. Some sequences may be incorrectly placed and some repeat units may not as yet be identified (Table 21). More recently, an additional repeat was identified in CA125 as shown in Tables 22 and 23 (SEQ. ID NOS: 307 and 308). The exact position has not yet been identified. Also, there is a potential that alternate splicing and/or mutation could account for some of the repeat variants that are listed. Studies are being conducted to compare both normal tissue derived CA125 repeats to individual tumor derived CA125 repeats to determine if such variation is present. Currently, the known exon configurations would easily accommodate the greater than 60 repeat units as projected. It is, therefore, unlikely that alternate splicing is a major contributor to the repetitive sequences in CA125. It should also be noted that the genomic database for chromosome 19q 13.2 only includes about 10 repeat units, thus indicating a discrepancy between the data of the present invention (more than 60 repeats) and the genomic database. A recent evaluation of the methods used for selection and assembly for genomic sequence [Marshall E, DNA Sequencing: Genome teams adjust to shotgun marriage, Science 292: 1982-1983 (2001)] reports that "more research is needed on repeat blocks of almost identical DNA sequence which are more common in the human genome. Existing assembly programs can't handle them well and often delete them." The CA125 repeat units located on chromosome 19 may well be victims of deletion in the genomic database, thus accounting for most CA125 repeat units absent from the current databases.

A. Sequence Confirmation and Assembly of the Amino Terminal Domain (Domain 1) of the CA125 Molecule As previously mentioned, homology for repeat sequences was found in the chromosome 19 cosmid AC008734 of the GCG database. This cosmid at the time consisted of 35 unordered contigs. After searching the cosmid for repeat sequences, contig #32 was found to have exons 1 and 2 of a repeat unit at its 3' end. Contig #32 also had a large open reading frame upstream from the two repeat units, which suggested that this contig contained sequences consistent with the amino terminal end of the CA125 molecule. A sense primer was synthesized to the upstream non-repeat part of contig #32 coupled with a specific primer from within the repeat region (see Methods). PCR amplification of ovarian tumor cDNA confirmed the contiguous positioning of these two domains.

The PCR reaction yielded a band of approximately 980 bp. The band was sequenced and found to connect the upstream open reading frame to the repeat region of CA125. From these data, more primer sets (see Methods) were synthesized and used in PCR reactions to piece together the entire open reading frame contained in contig #32. To find the 5' most end of the sequence, an EST (AU33673) was discovered, which linked contig #32 to contig #7 of the same cosmid. Specific primers were synthesized, (5'-CTGATGGCATTATGGAA-CACATCAC-3' (SEQ ID NO: 59) and 5'-CCCAGAAC-GAGAGACCAGTGAG-3' (SEQ ID NO: 60)), to the EST and contig #32. A PCR reaction was performed to confirm that part of the EST sequence was in fact contiguous with contig #32. Confirmation of this contiguous 5' prime sequencing strategy using overlapping sequences allowed the assembly of the 5' region (Domain 1) (FIG. 8A). 5' RACE PCR was performed on tumor cDNA to confirm the amino terminal sequence to CA125. The test confirmed the presence of contig #7 sequence at the amino terminal end of CA125.

The amino terminal domain comprises five genomic exons covering approximately 13,250 bp. Exon 1, a small exon, (amino acids #1-33) is derived from contig #7 (FIG. 8A). The remaining exons are all derived from contig #32: Exon 2 (amino acids #34-1593), an extraordinarily large exon, Exon 3 (amino acids #1594-1605), Exon 4 (amino acids #1606-1617) and Exon 5 (amino acids #1618-1637) (see FIG. 8A).

Potential N-glycosylation sites marked (x) are encoded at positions #81, #271, #320, #624, #795, #834, #938, and #1,165 (see FIG. 8B). O-glycosylation sites are extraordinarily abundant and essentially cover the amino terminal domain (FIG. 8B). As shown by the O-glycosylation pattern, Domain 1 is highly enriched in both threonine and serine (FIG. 8B).

With additional research, an extension of the glycosylated amino terminal sequence was identified and cloned. Table 24 (SEQ ID NO: 309) illustrates the DNA sequence of the CA125 amino terminal extension. Table 25 (SEQ ID NO: 310) illustrates the protein sequence for the amino terminal extension of the CA125 gene. It should be noted that the last four amino acids, TDGI, in SEQ ID NO: 310 belong to exon 1 of the amino terminal domain. Table 26 illustrates the serine/threonine o-glycosylation pattern for the CA125 amino terminal extension.

B. Sequence Confirmation and Assembly of the CA125 Carboxy Terminal End (Domain 3)

A search of Genbank using the repeat sequences described above uncovered a cDNA sequence referred to as Genbank accession number AK024365. This sequence was found to have 2 repeat sequences, which overlapped 2 known repeat sequences of a series of 6 repeats. As a result, the cDNA allowed the alignment of all six carboxy terminal repeats along with a unique carboxy terminal sequence. The carboxy terminus was further confirmed by the existence of two other ESTs (Genbank accession numbers AW150602 and A1923224), both of which confirmed a stop codon as well as a poly-A signal sequence and a poly-A tail (see GCG database #AF414442). The sequence of the carboxy terminal domain was confirmed using primers designed to sequence just downstream of the repeat domain (sense primer 5' GGA CAA GGT CAC CAC ACT CTA C-3') (SEQ ID NO: 303) and an antisense primer (5'-GCA GAT CCT CCA GGT CTA GGT GTG-3') (SEQ ID NO: 304) designed to carboxy terminus (FIG. 9A).

The carboxy terminal domain covers more than 14,000 genomic bp. By ligation, this domain comprises nine exons as shown in FIG. 9A. The carboxy-termninus is defined by a 284 amino acid sequence downstream from the repeat domains (see FIG. 9B). Both N-glycosylation sites marked (x) (#31, #64, #103, #140, #194, #200) and a small number of O-glycosylation sites marked (o) are predicted for the carboxy end of the molecule (FIGS. 9A, 9B). Of special note is a putative transmembrane domain at positions #230-#252 followed by a cytoplasmic domain, which is characterized by a highly basic sequence adjacent to the membrane (#256-#260) as well as several potential S/T phosphorylation sites (#254, #255, #276) and tyrosine phosphorylation sites (at #264, #273, #274) (FIGS. 9A, 9B).

Assembly of the CA125 molecule as validated by PCR amplification of overlap sequence provides a picture of the whole molecule (see FIG. 10 and Table 21). The complete nucleotide sequence is available in Genebank, Accession #AF414442 and the amino acid sequence as currently aligned is shown in Table 21.

DISCUSSION

The CA125 molecule comprises three major domains; an extracellular amino terminal domain (Domain 1), a large multiple repeat domain (Domain 2) and a carboxy terminal domain (Domain 3), which includes a transmembrane anchor with a short cytoplasmic domain (FIG. 10). The amino terminal domain is assembled by combining five genomic exons, four very short amino terminal sequences and one extraordinarily large exon, which often typifies mucin extracellular glycosylated domains [Desseyn J L et al., Human mucin gene MUC5B, the 10.7-kb large central exon encodes various alternate subdomains resulting in a super-repeat. Structural evidence for a 11p15.5 gene family, J. Biol. Chem. 272(6):3168-3178 (1997)]. This domain is dominated by its capacity for O-glycosylation and its resultant richness in serine and threonine residues. Overall, the potential for O-glycosylation essentially covers this domain and, as such, may allow the carbohydrate superstructure to influence ECM interaction at this end of the CA125 molecule (FIG. 8). There is one short area (amino acids #74-120) where little or no glycosylation is predicted, which could allow for protein-protein interaction in the extracellular matrix.

Efforts to purify CA125 over the years were obviously complicated by the presence of this amino terminal domain, which is unlikely to have any epitope sites recognized by the OC125 or M11 class antibodies. As the CA125 molecule is degraded in vivo, it is likely that this highly glycosylated amino terminal end will be found associated with varying numbers of repeat units. This could very well account for both the charge and size heterogeneity of the CA125 molecule so often identified from serum and ascites fluid. Also of note are two T-TALK sequences at amino acids #45-58 (underlined in FIG. 8B), which are unique to the CA125 molecule.

The extracellular repeat domain, which characterizes the CA125 molecule, also represents a major portion of the molecular structure. It is downstream from the amino terminal domain and presents itself in a much different manner to its extracellular matrix neighbors. These repeats are characterized by many features including a highly-conserved nature (FIG. 3) and a uniformity in exon structure (FIG. 7). But most consistently, a cysteine enclosed sequence may form a cysteine loop (Table 21). This structure may provide extraordinary potential for interaction with neighboring matrix molecules. Domain 2 encompasses the 156 amino acid repeat units ofthe CA125 molecule. The repeat domain constitutes the largest proportion of the CA125 molecule (Table 21 and FIG. 10). Because it has been known for more than 15 years that antibodies bind in a multivalent fashion to CA125, it has been predicted that the CA125 molecule would include multiple repeat domains capable of binding the OC125 and M11 class of sentinel antibodies which define this molecule [O'Brien et al., New monoclonal antibodies identify the glycoprotein carrying the CA125 epitope, Am J Obstet Gynecol. 165:1857-1964 (1991); Nustad K et al., Specificity and affinity of 26 monoclonal antibodies against the CA125 antigen: First report from the ISOBM TD-1 workshop, Tumor Biology 17:196-219 (1996); and Bast R C et al., A radioimmunoassay using a monoclonal antibody to monitor the course of epithelial ovarian cancer, N. Engl. J Med. 309:883-887 (1983)]. In the present invention, more than 60 repeat units have been identified, which are in tandem array in the extracellular portion of the CA125 molecule. Individual repeat units have been confirmed by sequencing and further identified by PCR amplification of the overlapping repeat sequences. Results confirm the contiguous placement of most repeats relative to its neighbor (Table 21).

Initial evidence suggests that this area is a potential site for antibody binding and also for ligand binding. The highly conserved methionine and several highly conserved sequences within the repeat domain also suggests a functional capacity for these repeat units. The extensive glycosylation of exons 4 & 5 of the repeat unit and the N-glycosylation potential in exon 1 and the 5' end of exon 2 might further point to a functional capacity for the latter part of exon 2 and exon 3 which includes the C-enclosure (see FIG. 7). It should be apparent that the C-enclosure might be a prime target for protease activity and such cleavage may well explain the difficulty experienced by many investigators in obtaining an undigested CA125 parent molecule. Such activity might explain the diffuse pattern of antibody binding and the loss of antibody binding for molecules of less than 200,000 kDa. Proteolysis would destroy the epitopes and, therefore, only multiple repeats could be identified by blotting with CA125 antibodies. The repeat unit organization also suggests the potential for a multivalent interaction with extracellular entities.

The carboxy terminal domain of the CA125 molecule comprises an extracellular domain, which does not have any homology to other known domains. It encodes a typical transmembrane domain and a short cytoplasmic tail. It also contains a proteolytic cleavage site approximately 50 amino acids upstream from the transmembrane domain. This would allow for proteolytic cleavage and release of the CA125 molecule (FIG. 9). As indicated by Fendrick, et al. [CA125 phosphorylation is associated with its secretion from the WISH human amnion cell line, Tumor Biology 18:278-289 (1997)], release of the CA125 molecule is preceded by phosphorylation and sustained by inhibitors of phosphatases, especially inhibition of phosphatase 2B. The cytoplasmic tail which contains S/T phosphorylation sites next to the transmembrane domain and tyrosine phosphorylation sites downstream from there could accommodate such phosphorylation. A very distinguishable positively charged sequence is present upstream from the tyrosine, suggesting a signal transduction system involving negatively charged phosphate groups and positively charged lysine and arginine groups.

These features of the CA125 molecule suggest a signal transduction pathway involvement in the biological function of CA125 [Fendrick J L et al., CA125 phosphorylation is associated with its secretion from the WISH human amnion cell line, *Tumor Biology* 18:278-289 (1997); and Konish I et al., Epidermal growth factor enhances secretion of the ovarian tumor-associated cancer antigen CA125 from the human amnion WISH cell line, *J Soc. Gynecol. Invest.* 1:89-96 (1994)]. It also reinforces the prediction of phosphorylation prior to CA125 release from the membrane surface as previously proposed [Fendrick J L et al., CA125 phosphorylation is associated with its secretion from the WISH human amnion cell line, *Tumor Biology* 18:278-289 (1997); and Konish I et al., Epidermal growth factor enhances secretion of the ovarian tumor-associated cancer antigen CA125 from the human amnion WISH cell line, *J Soc. Gynecol. Invest.* 1:89-96 (1994)]. Furthermore, a putative proteolytic cleavage site on the extra-cellular side of the transmembrane domain is present at position #176-181.

How well does the CA125 structure described in the present invention compare to the previously known CA125 structure? O'Brien et al. reported that a number of questions needed to be addressed: 1) the multivalent nature of the molecule; 2) the heterogeneity of CA125; 3) the carbohydrate composition; 4) the secretory or membrane bound nature of the CA125 molecule; 5) the function of the CA125 molecule; and 6) the elusive CA125 gene [More than 15 years of CA125: What is known about the antigen, its structure and its function, *Int J Biological Markers* 13(4)188-195 (1998)]. Several of these questions have been addressed in the present invention including, of course, the gene and its protein core product. Perhaps, most interestingly is the question of whether an individual large transcript accounted for the whole CA125 molecule, or a number of smaller transcripts which represented subunits that specifically associated to produce the CA125 molecule. From the results produced by way of the present invention, it is now apparent that the transcript of CA125 is large—similar to some of the mucin gene transcripts e.g. MUC 5B [see Verma M et al., Mucin genes: Structure, expression and regulation, *Glycoconjugate J* 11:172-179 (1994); and Gendler S J et al., Epithelial mucin genes, *Annu. Rev. Physiol.* 57:607-634 (1995)]. The protein core extracellular domains all have a high capacity for O-glycosylation and, therefore, probably accounts for the heterogeneity of charge and size encountered in the isolation of CA125. The data also confirm the O-glycosylation inhibition data, indicating CA125 to be rich in O-glycosylation [Lloyd K O et al., Synthesis and secretion of the ovarian cancer antigen CA125 by the human cancer cell line NIH: OVCAR-3, *Tumor Biology* 22, 77-82 (2001); Lloyd K O et al., Isolation and characterization of ovarian cancer antigen CA125 using a new monoclonal antibody (VK-8): Identification as a mucin-type molecule, *Int. J. Cancer*, 71:842-850 (1997); and Fendrick J L et al., Characterization of CA125 synthesized by the human epithelial amnion WISH cell line, *Tumor Biology* 14:310-318 (1993)].

The repeat domain which includes more than 60 repeat units accounts for the multivalent nature of the epitopes present, as each repeat unit likely contains epitope binding sites for both OC125-like antibodies and M11-like antibodies. The presence of a transmembrane domain and cleavage site confirms the membrane association of CA125, and reinforces the data which indicates a dependence of CA125 release on proteolysis. Also, the release of CA125 from the cell surface may well depend on cytoplasmic phosphorylation and be the result of EGF signaling [Nustad K et al., Specificity and affinity of 26 monoclonal antibodies against the CA125 antigen: First report from the ISOBM TD-1 workshop, Tumor Biology 17:196-219 (1996)]. As for the question of inherent capacity of CA125 for proteolytic activity, this does not appear to be the case. However, it is likely that the associated proteins isolated along with CA125 (e.g. the 50 kDa protein which has no antibody binding ability) may have proteolytic activity. In any case, proteolysis of an extracellular cleavage site is the most likely mechanism of CA125 release. Such cleavage would be responsive to cytoplasmic signaling and mediated by an associated extracellular protease activity.

In summary, the large number of tandem repeats of the CA125 molecule, which dominate its molecular structure and contain the likely epitope binding sites of the CA125 molecule, was unexpected. Also, one cannot as yet account for the proteolytic activity, which has plagued the isolation and characterization of this molecule for many years. While no protease domain per se is constituitively part of the CA125 molecule, there is a high likelihood of a direct association by an extracellular protease with the ligand binding domains of the CA125 molecule. Finally, what is the role of the dominant repeat domain of this extracellular structure? Based on the expression data of CA125 on epithelial surfaces and in glandular ducts, it is reasonable to conclude that the unique structure of these repeat units with their cysteine loops plays a role both as glandular anti-invasive molecules (bacterial entrapment) and/or a role in anti-adhesion (maintaining patency) between epithelial surfaces and in ductal linings.

Recently, Yin and Lloyd described the partial cloning of the CA125 antigen using a completely different approach to that described in the present invention [Yin T W T et al., Molecular cloning of the CA125 ovarian cancer antigen. Identification as a new mucin (MUC 16), *J Biol. Chem.* 276:27371-27375 (2001)]. Utilizing a polyclonal antibody to CA125 to screen an expression library of the ovarian tumor cell line OVCAR-3, these researchers identified a 5965 bp clone containing a stop codon and a poly A tail, which included nine partially conserved tandem repeats followed by a potential transmembrane region with a cytoplasmic tail. The 5965 bp sequence is almost completely homologous to the carboxy terminus region shown in Table 21. Although differing in a few bases, the sequences are homologous. As mentioned above, the cytoplasmic tail has the potential for phosphorylation and a transmembrane domain would anchor this part of the CA125 molecule to the surface of the epithelial or tumor cell. In the extracellular matrix, a relatively short transition domain connects the transmembrane anchor to a series of tandem repeats—in the case of Yin and Lloyd, nine.

By contrast, the major extracellular part of the molecule of the present invention as shown is upstream from the sequence described by Yin and includes a large series of tandem repeats. These results, of course, provide a different picture of the CA125 molecule, which suggest that CA125 is dominated by the series of extracellular repeats. Also included is a major amino terminal domain (~1638 amino acids) for the CA125 molecule, which it is believed accounts for a great deal of the O-glycosylation known to be an important structural component of CA125.

In conclusion, a CA125 molecule is disclosed which requires a transcript of more than 35,000 bases and occupies approximately 150,000 bp on chromosome 19q 13.2. It is dominated by a large series of extracellular repeat units (156 amino acids), which offer the potential for molecular interactions especially through a highly conserved unique cysteine loop. The repeat units also include the epitopes now well-described and classified for both the major class of CA125 antibodies (i.e., the OC125 and the M11 groups). The CA125 molecule is anchored at its carboxy terminal through a trans-membrane domain and a short cytoplasmic tail. CA125 also contains a highly glycosylated amino terminal domain, which includes a large extracellular exon typical of some mucins. Given the massive repeat domain presence of both epithelial surfaces and ovarian tumor cell surfaces, it might be anticipated that CA125 may play a major role in determining the extracellular environment surrounding epithelial and tumor cells.

Advantages and Uses of the CA125 Recombinant Products

1) Current assays to CA125 utilize as standards either CA125 produced from cultured cell lines or from patient ascites fluid. Neither source is defined with regard to the quality or purity of the CA125 molecule. Therefore arbitrary units are used to describe patient levels of CA125. Because cut-off values are important in the treatment of patients with elevated CA125 and because many different assay systems are used clinically to measure CA125, it is relevant and indeed necessary to define a standard for all CA125 assays. Recombinant CA125 containing epitope binding sites could fulfill this need for standardization. Furthermore, new and more specific assays may be developed utilizing recombinant products for antibody production.

There are now some highly reliable computer programs that can identify peptide sequences within the primary structure of a protein that are likely to be immunogenic. Such programs can be used to identify immunogenic sequences within the inferred CA125 structure. Thus, knowledge of the nucleotide sequence of CA125 cDNA and genomic DNA can lead to the design of synthetic "epitopes" and preparation of highly specific polyclonal and monoclonal antibodies. Antibodies are useful in the development of immuno assays having diagnostic uses. Alternatively, a recombinant expression of CADS protein clearly provides an appropriate antigen for preparing specific antibodies of CA125.

2) Vaccines: Adequate data now exists [see Wagner U et al., Immunological consolidation of ovarian carcinoma recurrences with monoclonal anti-idiotype antibody ACA125: Immune responses and survival in palliative treatment, *Clin. Cancer Res.* 7:1112-1115 (2001)], which suggest and support the idea that CA125 could be used as a therapeutic vaccine to treat patients with ovarian carcinoma. Heretofore, in order to induce cellular and humoral immunity in humans to CA125, murine antibodies specific for CA125 were utilized in anticipation of patient production of anti-ideotypic antibodies, thus indirectly allowing the induction of an immune response to the CA125 molecule. With the availability of recombinant CA125, especially domains which encompass epitope binding sites for known murine antibodies and domains directly anchoring CA125 on the tumor cell, it will be feasible to more directly stimulate patients' immune systems to CA125 and as a result, extend the life of ovarian carcinoma patients as demonstrated by Wagner et al.

Several approaches can be utilized to achieve such a therapeutic response in the immune system by: 1) directly immunizing the patient with recombinant antigen containing the CA125 epitopes or other domains; 2) harvesting dendritic cells from the patient; 3) expanding these cells in in vitro culture; 4) activating the dendritic cells with the recombinant CA125 epitope domain or other domains or with peptides derived from these domains [see Santin A D et al., Induction of ovarian tumor-specific CD8+ cytotoxic T lymphocytes by acid-eluted peptide-pulsed autologous dendritic cells, *Obstetrics & Gynecology* 96(3):422-430 (2000)]; and then 5) returning these immune stem cells to the patient to achieve an immune response to CA125. This procedure can also be accomplished using specific peptides which are compatible with histocompatibility antigens of the patient. Such peptides compatible with the HLA-A2 binding motifs common in the population are indicated in FIG. 12.

3) Therapeutic Targets: Molecules, which are expressed on the surface of tumor cells as CA125 is, offer potential targets for immune stimulation, drug delivery, biological modifier delivery or any agent which can be specifically delivered to ultimately kill the tumor cells. CA125 offers such potential as a target: 1) Antibodies to CA125 epitopes or newly described potential epitopes: Most especially humanized or human antibodies to CA125 which could directly activate the patients' immune system to attack and kill tumor cells. Antibodies could be used to deliver all drug or toxic agents including radioactive agents to mediate direct killing of tumor cells. 2) Natural ligands: Under normal circumstances, molecules are bound to the CA125 molecule e.g. a 50 k dalton protein which does not contain CA125 epitopes co-purifies with CA125. Such a molecule, which might have a natural binding affinity for domains on the CA125 molecule, could also be utilized to deliver therapeutic agents to tumor cells.

4) Anti-sense therapy: CA125 expression may provide a survival or metastatic advantage to ovarian tumor cells as such antisense oligonucleotide derived from the CA125 sequence could be used to down-regulate the expression of CA125. Antisense therapy could be used in association with a tumor cell delivery system such as described above.

5) Small Molecules: Recombinant domains of CA125 also offer the potential to identify small molecules which bind to individual domains of the molecule. Small molecules either from combinatorial chemical libraries or small peptides can also be used as delivery agents or as biological modifiers.

6) Transgenic Animals/Transformed: CA125 and genomic DNA can be used to develop transgenic animal models and can be used under low stringency conditions, to clone CA125 cDNAs and genomic DNAs of other animal species (would this be worthwhile?). The CA125 cDNA can be used to prepare stable transformants. The bacterial cells could be transformed with CA125 cDNA to include these genes.

All references referred to herein are hereby incorporated by reference in their entirety.

It should be understood that various changes and modifications to the presently preferred embodiments described herein will be apparent to those skilled in the art. Such changes and modifications can be made without departing from the spirit and scope of the present invention and without diminishing its attendant advantages.

TABLE 1

Comparison of the Amino Acid Terminal Sequences and Several Internal Sequences for the 40 kD Band for CA125 glycoprotein (SEQ ID NO: 1 through SEQ ID NO: 4) to the Nucleotide and Amino Acid Sequences for EST Genbank Accession No. AA640762 (SEQ ID NO: 5 and SEQ ID NO: 6, respectively)

```
40kDa Nterm - QHPGSRKFKTTEG  (SEQ ID NO: 1)
Peak 68 - FLTVERVLQGL        (SEQ ID NO: 2)
Peak 65 - DTYVGPLY           (SEQ ID NO: 3)
Peak 30 - DGAANGVD           (SEQ ID NO: 4)
(SEQ ID NO: 5 and SEQ ID NO: 6)
                    ↓
  1 CGTCGACCTGGCTCTAGAAAGTTTAACACCACGGAGAGAGTCCTTCAGGGTCTGCTCAGG
     R  R  P  G  S  R  K  F  N  T  T  E  R  V  L  Q  G  L  L  R
                             ↓
 61 CCTGTGTTCAAGAACACCAGTGTTGGCCCTCTGTACTCTGGCTGCAGACTGACCTTGCTC
     P  V  F  K  N  T  S  V  G  P  L  Y  S  G  C  R  L  T  L  L
                    ↓
121 AGGCCCAAGAAGGATGGGGCAGCCACCAAAGTGGATGCCATCTGCACCTACCGCCCTGAT
     R  P  K  K  D  G  A  A  T  K  V  D  A  I  C  T  Y  R  P  D
181 CCCAAAAGCCCTGGACTGGACAGAGAGCAGCTATACTGGGAGCTGAGCCAGGGTGATGCA
     P  K  S  P  G  L  D  R  E  Q  L  Y  W  E  L  S  Q  G  D  A
```

TABLE 2A

Nucleotide and Amino Acid Sequences for Sense Primer 5' 3' (SEQ ID NO: 7 and SEQ ID NO: 8 respectively) and Antisense Primer 5' 3' (SEQ ID NO: 9 and SEQ ID NO: 10 respectively) based upon Regions of Homology for EST Genbank Accession Nos. BE005912 and AA640762)

```
GGA GAG GGT TCT GCA GGG TC      (SEQ ID NO: 7)
 E   R   V   L   Q   G          (SEQ ID NO: 8)

GTG AAT GGT ATC AGG AGA GG      (SEQ ID NO: 9)
 P   L   L   I   P   F          (SEQ ID NO: 10)
```

TABLE 2B

Sense and Anti-Sense Primers Used for Ordering Repeat Units (SEQ ID NO: 301 and SEQ ID NO: 302, respectively)

```
5'-GTCTCTATGTCAATGGTTTCACCC-3'   (SEQ ID NO: 301)

5'-TAGCTGCTCTCTGTCCAGTCC-3'      (SEQ ID NO: 302)
```

TABLE 3

Amino Acid Sequence for a 400 by Repeat in the CA125 Molecule (SEQ ID NO: 11 thru SEQ ID NO: 21)

```
          1                                                    50
     12  ERVLQGLLRS LFKSTSVGPL YSGCRLTLLR PEKDGTATGV DAICTHHPDP (SEQ ID NO: 11)
     34  ERVLQGLLMP LFKNTSVSSL YSGCRLTLLR PEKDGAATRA DAVCTHRPDP (SEQ ID NO: 12)
     32  ERVLQGLLGP IFKNTSVGPL YSGCRLTSLR SEKDGAATGV DAICIHRLDP (SEQ ID NO: 13)
     46  ERVLQGLLGP MFKNTSVGLL YSGCRLTLLR PEKNGAATGM DAICSHRLDP (SEQ ID NO: 14)
     33  ERVLQGLLGP LFKNSSVGPL YSGCRLISLR SEKDGAATGV DAICTHHLNP (SEQ ID NO: 15)
     15  ERVLQGLLRP LFKSTSAGPL YSGCRLTLLR PEKHGAATGV DAICTLRLDP (SEQ ID NO: 16)
     35  ERVLQGLLKP LFKSTSVGPL YSGCRLTLLR PEKRGAATGV DTICTHRLDP (SEQ ID NO: 17)
    111  ERVLQGLLTP LFKNTSVGPL YSGCRLTLLR PEKQEAATGV DTICTHRVDP (SEQ ID NO: 18)
     42  ERVLQGLLKP LFKNATSVGPL YSGCRLTLLR PEKHEAATGV DTICTHRLDP (SEQ ID NO: 19)
    116  ERVLQGLLSP IFKNSSVGPL YSGCRLTSLR PEKDGAATGM DAVCLYHPNP (SEQ ID NO: 20)
     23  ERVLQGLLRP LFKNTSIGPL YSSCRLTLLR PEKDKAATRV DAICTHHPDP (SEQ ID NO: 21)

51                                                   100
     12  KSPRLDREQL YWELSQLTHN ITELGPYALD NDSLFVNGFT HRSSVSTTST
     34  KSPGLDRERL YWKLSQLTHG ITELGPYTLD RHSLYVNGFT HQSSMTTTRT
     32  KSPGLNREQL YWELSKLTND IEELGPYTLD RNSLYVNGFT HQSSVSTTST
     46  KSPGLNREQL YWELSQLTHG IKELGPYTLD RNSLYVNGFT HRSSVAPTST
     33  QSPGLDREQL YWQLSQMTNG IKELGPYTLD RNSLYVNGFT HRSSGLTTST
     15  TGPGLDRERL YWELSQLTNS VTELGPYTLD RDSLYVNGFT HRSSVPTTSI
     35  LNPGLDREQL YWELSKLTRG ITELGPYTLD RDSLYVNGFT HRSSVPTTSI
    111  IGPGLDRERL YWELSQLTNS ITELGPYTLD RDSLYVDGFN PWSSVPTTST
     42  LNPGLDREQL YWELSKLTRG IIELGPYTLD RGSLYVNGFT HRNFVPITST
    116  KRPGLDREQL YWELSQLTHN ITELGPYSLD RSLYVNGFT HQNSVPTTST
     23  QSPGLNREQL YWELSQLTHG ITELGPYTLD RDSLYVNGFT HWSPIPTTST 101                                                  150
     12  PGTPTVYLGA SKTPASIFGP S..AASPLLI PFT------- ----------
```

TABLE 3-continued

Amino Acid Sequence for a 400 by Repeat in the CA125 Molecule
(SEQ ID NO: 11 thru SEQ ID NO: 21)

```
 34 PDTSTMHLAT SRTPASLSGP T..TASPLLI PF-------- ----------
 32 PGTSTVDLRT SGTPSSLSSP TIMAAGPLLI PF-------- ----------
 46 PGTSTVDLGT SGTPSSLPSP T..TAVPLLI PF-------- ----------
 33 PWTSTVDLGT SGTPSPVPSP T..TAGPFLI PF-------- ----------
 15 PGTSAVHLET SGTPASLPGH T..APGPLLI PF-------- ----------
 35 PGTSAVHLET SGTPASLPGH I..VPGPLLI PF-------- ----------
111 PGTSTVHLAT SGTPSPLPGH T..APVPLLI PFT------- ----------
 42 PGTSTVHLGT SETPSSLPRP I..VPGPLLV PFT------- ----------
116 PGTSTVYWAT TGTPSSFPGH T..EPGPLLI PF-------- ----------
 23 PGTSIVNLGT SGIPPSLPET T..ATGPLLI PFT------- ----------

151        170
 12 ---------- ----------
 34 ---------- ----------
 32 ---------- ----------
 46 ---------- ----------
 33 ---------- ----------
 15 ---------- ----------
 35 ---------- ----------
111 ---------- ----------
 42 ---------- ----------
116 ---------- ----------
 23 ---------- ----------
```

TABLE 4

Amino Acid Sequence for a 800 by Repeat in the CA125 Molecule
(SEQ ID NO: 22 thru SEQ ID NO: 35)

```
     1                                                  50
 79 ERVLQGLLKP LFRNSSLEYL YSGCRLASLR PEKDSSAMAV DAICTHRPDP(SEQ ID NO: 22)
811 ERVLQGLLKP LFRNSSLEYL YSGCRLASLR PEKDSSAMAV DAICTHRPDP(SEQ ID NO: 23)
 21 ERVLQGLLKP LFKSTSVGPL YSGCRLTLLR PEKRGAATGV DTICTHRLDP(SEQ ID NO: 24)
 89 ERVLQGLLKP LFKSTSVGPL YSGCRLTLLR PEKRGAATGV DTICTHRLDP(SEQ ID NO: 25)
 85 ERVLQGLLKP LFKSTSVGPL YSGCRLTLLR PEKRGAATGV DTICTHRLDP(SEQ ID NO: 26)
712 ERVLQGLLKP LFKSTSVGPL YSGCRLTLLR PEKRGAATGV DTICTHRLDP(SEQ ID NO: 27)
 86 ERVLQGLLKP LFKSTSVGPL YSGCRLTLLR PEKHGAATGV DAICTLRLDP(SEQ ID NO: 28)
 87 ERVLQGLLTP LFKNTSVGPL YSGCRLTLLR PEKQEAATGV DTICTHRVDP(SEQ ID NO: 29)
810 ERVLQGLLRP LFKNTSIGPL YSSCRLTLLR PEKDKAATRV DAICHHPDP(SEQ ID NO: 30)
 83 ERVLQGLLKP VFKNTSVGPL YSGCRLTLLR PKKDGAATKV DAICTYRPDP(SEQ ID NO: 31)
 81 ERVLQGLLGP MFKNTSVGLL YSGCRLTLLR PKKDGAATKV DAICTYRPDP(SEQ ID NO: 32)
 44 ERVLQGLLKP LFKSTSVGPL YSGCRLTLLR PEKDGAATGM DAVCLYHPNP(SEQ ID NO: 33)
812 ERVLQGLLSP ISKNSSVGPL YSGCRLTSLR PEKDGAATGM DAVCLYHPNP(SEQ ID NO: 34)
 76 ERVLQGLLSP IFKNSSVGSL YSGCRLTLLR PEKDGAATRV DAVCTHRPDP(SEQ ID NO: 35)

51                                                 100
 79 EDLGLDRERL YWELSNLTNG IQELGPYTLD RNSLYVNGFT HRSSMPTTST
811 EDLGLDRERL YWELSNLTNG IQELGPYTLD RNSLYVNGFT HRSSGLTTST
 21 LNPGLDREQL YWELSKLTRG IIELGPYLLD RGSLYVNGFT HRTSVPTTST
 89 LNPGLDREQL YWELSKLTRG IIELGPYLLD RGSLYVNGFT HRNFVPITST
 85 LNPGLDREQL YWELSKLTRG IIELGPYLLD RGSLYVNGFS RQSSMTTTRT
712 LNPGLDREQL YWELSKLTRG IIELGPYLLD RDSLYVNGFT HRSSVPTTSI
 86 TGPGLDRERL YWELSQLTNS VTELGPYTLD RDSLYVNGFT HRSSVPTTST
 87 IGPGLDRERL YWELSQLTNS ITELGPYTLD RDSLYVNGFN PWSSVPTTST
810 QSPGLNREQL YWELSQLTHG ITELGPYTLD RDSLYVDGFT HWSPIPTTST
 83 KSPGLDREQL YWELSQLTHS ITELGPYTLD RDSLYVNGFT QRSSVPTTSI
 81 KSPGLDREQL YWELSQLTHS ITELGPYTLD RDSLYVNGFT QRSSVPTTSI
 44 KRPGLDREQL YCELSQLTHD ITELGPYSLD RDSLYVNGFT HQNSVPTTST
812 KRPGLDREQL YWELSQLTHN ITELGPYSLD RDSLYVNGFT HQNSVPTTST
 76 KSPGLDRERL YWKLSQLTHG ITELGPYTLD RHSLYVNGFT HQSSMTTTRT 101                                                150
 79 PGTSTVDVGT SGTPSSSPSP TTAGPLLMPF TLNFTITNLQ YEEDMRRTGS
811 PWTSTVDLGT SGTPSPVPSP TTAGPLLIPF TLNFTITNLQ YEENMGHPGS
 21 PGTSTVDLGT SGTPFSLPSP ATAGPLLVLF TLNFTITNLK YEEDMHRPGS
 89 PGTSTVHLGT SETPSSLPRP IVPGPLLIPF TINFTITNLR YEENMHHPGS
 85 PDTSTMHLAT SRTPASLSGP TTASPLLIPF TLNFTITNLQ YEENMGHPGS
712 PGTSAVHLET FGTPASLHGH TAPGPVLVPF TLNFTITNLQ YEEDMRHPGS
 86 PGTSAVHLET SGTPASLPGH TAPGPLLVPF TLNFTITNLQ YEEDMRHPGS
 87 PGTSTVHLAT SGTPSSLPGH TAPVPLLIPF TLNFTITNLH YEENMQHPGS
810 PGTSIVNLGT SGIPPSLPET TATGPLLIPF TPNFTITNLQ YEEDMRRTGS
 83 PGTPTVDLGT SGTPVSKPGP SAASPLLVPF TLNFTITNLQ YEEDMRHPGS
 81 PGTPTVDLGT SGTPVSKPGP SAASPLLVPF TINFTITNLR YEENMGHPGS
 44 PGTSTVYWAT TGTPSSFPGH TEPGPLLIPF TFNFTITNLH YEENMQHPGS
```

TABLE 4-continued

Amino Acid Sequence for a 800 by Repeat in the CA125 Molecule
(SEQ ID NO: 22 thru SEQ ID NO: 35)

```
    812 PGTSTVYWAT TGTPSSFPGH TEPGPLLIPF TINFTITNLR YEENMHHPGS
     76 PDTSTMHLAT SRTPASLSGP TTASPLLVLF TINFTITNQR YEENMHHPGS 151                                                200
     79 RKFNTMERVL QGLLSPIFKN SSVGPLYSGC RLTSLRPEKD GAATGMDAVC
    811 RKFNIMERVL QGLLMPLFKN TSVSSLYSGC RLTLLRPEKD GAATRVDAVC
     21 RKFNTTERVL QTLLGPMFKN TSVGLLYSGC RLTLLRSEKD GAATGVDAIC
     89 RKFNIMERVL QGLLGPLFKN SSVGPLYSGC RLISLRSEKD GAATGVDAIC
     85 RKFNIMERVL QGLLNPIFKN SSVGPLYSGC RLTSLKPEKD GAATGMDAVC
    712 RKFNTTERVL QGLLKPLFKS TSVGPLYSGC RLTLLRPEKR GAATGVDTIC
     86 RKFNTTERVL QGLLKPLFKS TSVGPLYSGC RLTLLRPEKR GAATGVDTIC
     87 RKFNTTERVL QGLLKPLFKS TSVGPLYSGC RLTLLRPEKH GAATGVDAIC
    810 RKFNTMERVL QGLLSPIFKN SSVGPLYSGC RLTSLRPEKD GAATGMDAVC
     83 RKFNATERVL QGLLSPIFKN SSVGPLYSGC RLTSLRPEKD GAATGMDAVC
     81 RKFNIMERVL QGLLKPLFKN TSVGPLYSGC RLTLLRPKKD GAATGVDAIC
     44 RKFNTTERVL QGLLKPLFKN TSVGPLYSGC RLTLLRPEKH EAATGVDTIC
    812 RKFNTTERVL QGLLRPVFKN TSVGPLYSGC RLTLLRPKKD GAATKVDAIC
     76 RKFNTTERVL QGLLRPVFKN TSVGPLYSGC RLTLLRPKKD GAATKVDAIC 201                                                250
     79 LYHPNPKRPG LDREQLYWEL SQLTHNITEL GPYSLDRDSL YVNGFTHQSS
    811 TQRPDPKSPG LDRERLYWKL SQLTHGITEL GPYTLDRNSL YVNGLTHQSS
     21 THRLDPKSPG VDREQLYWEL SQLTNGIKEL GPYTLDRNSL YVNGFTHWIP
     89 THHLNPQSPG LDREQLYWQL SQMTNGIKEL GPYTLDRNSL YVNGFTHRSS
     85 LYHPNPKRPG LDREQLYWEL SQLTHGIKEL GPYTLDRNSL YVNGFTHRSS
    712 THRLDPLNPG LDREQLYWEL SKLTRGIIEL GPYLLDRGSL YVNGFTHRNF
     86 THRLDPLNPG LDREQLYWEL SKLTRGIIEL GPYLLDRGSL YVNGFTHRNF
     87 THRLDPKSPG VDREQLYWEL SQLTNGIKEL GPYTLDRNSL YVNGFTHWIP
    810 LYHPNPKRPG LDREQLY--- ---------- ---------- ----------
     83 LYHPNPKRPG LDREQLYWEL SQLTHNITEL GPYSLDRDSL YVNGFTHQSS
     81 THRLDPKSPG LNREQLYWEL SKLTNDIEEL GPYTLDRNSL YVNGFTHQSS
     44 THRVDPIGPG LDRERLYWEL SQLTNSIHEL GPYTLDRDSL YVNGFNPRSS
    812 TYRPDPKSPG LDREQLYWEL SKLTNDIEEL GPYTLDRNSL YVNGFTHQSS
     76 TYRPDPKSPG LDREQLYWEL SQLTHSITEL GPYTQDRDSL YVNGFTHRSS 251                             288
     79 VPTTSTPGTS TVYWATTGTP SSFPGHT..E PGPL----
    811 MTTTRTPDTS TMHLATSRTP ASLSGPT..T ASPLLIPF
     21 ---------- ---------- ---------- --------
     89 GLTTSTPWTS TVDLGTSGTP SPVPSPT..T AGPLLIPF
     85 VAPTSTPGTS TVDLGTSGTP SSLPSPT..T AVPLLIPF
    712 VPITSTPGTS TVHLGTSETP SSLPRPI..V PGPLLIPF
     86 VPITSTPGTS TVHLGTSETP SSLPRPI..V PGPLLIPF
     87 VPTSSTPGTS TVDLG.SGTP SSLPSPT..T AGPL----
    810 ---------- ---------- ---------- --------
     83 MTTTRTPDTS TMHLATSRTP ASLSGPT..T ASPLLIPF
     81 VSTTSTPGTS TVDLRTSGTP SSLSSPTIMA AGPLLIPF
     44 VPTTSTPGTS TVHLATSGTP SSLPGHT..A PVPLLI--
    812 VSTTSTPGTS TVDLRTSGTP SSLSSPTIMA AGPLLIPF
     76 VPTTSIPGTS AVHLETSGTP ASLP------ --------
```

TABLE 5

Amino Acid Sequence for a 1200 by Repeat in the CA125 Molecule
(SEQ ID NO: 36 thru SEQ ID NO: 46)

```
          1                                               50
    910 ERVLQGLLGP MFKNTSVGLL YSGCRLTLLR PEKRGAATGV DTICTHRLDP(SEQ ID NO: 36)
     99 ERVLHGLLTP LFKNTRVGPL YSGCRLTLLR PEKQEAATGV DTICTHRVDP(SEQ ID NO: 37)
    112 ---------- -------GPL YSGCRLTSLR PEKDGAATGM DAVCLYHPNP(SEQ ID NO: 38)
     95 ERVLQGPLSP IFKNSSVGPL YSGCRLTSLR PEKDGAATGM DAVCLYHPNP(SEQ ID NO: 39)
     71 ---------- ----TSVGPL YSGCRLTLLR SEKDGAATGV DAIYTHRLDP(SEQ ID NO: 40)
     78 ---------- ---------- ------TLLR PKKDGVATGV DAICTHRLDP(SEQ ID NO: 41)
    115 ERVLQGLLKP LFKSTSVGPL YSGCRLTLLR PEKDGVATRV DAICTHRPDP(SEQ ID NO: 42)
     91 ERVLQGLLKP LFRNSSLEYL YSGCRLASLR PEKDSSAMAV DAICTHRPDP(SEQ ID NO: 43)
     92 ERVLQGLLKP LFKSTSVGPL YSGCRLTLLR PEKRGAATGV DTICTHRLDP(SEQ ID NO: 44)
    113 ERVLQGLLGP MFKNTSVGLL YSGCRLTLLR PEKNGAATGM DAICSHRLDP(SEQ ID NO: 45)
    711 ERVLQGLLKP LFKSTSVGPL YSGCRLTLLR PEKHGAATGV DAICTLRLDP(SEQ ID NO: 46)

51                                               100
    910 LNPGLDREQL YWELSKLTRG IIELGPYLLD RGSLYVNGFT HRNFVPITST
     99 IGPGLDRERL YWELSQLTNS ITELGPYTLD RDSLYVNGFN PWSSVPTTST
    112 KRPGLDREQL YWELSQLTHN ITELGPYSLD RDSLYVNGFT HQNSVPTTST
     95 KRPGLDREQL YWELSQLTHN ITELGPYSLD RDSLYVNGFT HQNSVPTTST
```

TABLE 5-continued

Amino Acid Sequence for a 1200 by Repeat in the CA125 Molecule
(SEQ ID NO: 36 thru SEQ ID NO: 46)

```
 71 KSPGVDREQL YWELSQLTNG IKELGPYTLD RNSLYVNGFT HQTSAPNTST
 78 KSPGLNREQL YWELSKLTND IEELGPYTLD RNSLYVNGFT HQSSVSTTST
115 KIPGLDRQQL YWELSQLTHS ITELGPYTLD RDSLYVNGFT QRSSVPTTST
 91 EDLGLDRERL YWELSNLTNG IQELGPYTLD RNSLYVNGFT HRSSMPTTST
 92 LNPGLDREQL YWELSKLTRG IIELGPYLLD RGSLYVNGFT HRNFVPITST
113 KSPGLNREQL YWELSKLTHG IKELGPYTLD RNSLYVNGFT HRSSVAPTST
711 TGPGLDRERL YWELSQLTNS VTELGPYTLD RDSLYVNGFT HRSSVPTTSI 101                                              150
910 PGTSTVHLGT SETPSSLPRP IV..PGPLLV PFTLNFTITN LQYEEAMRHP
 99 PGTSTVHLAT SGTPSSLPGH TA..PVPLLI PFTLNFTITN LHYEENMQHP
112 PGTSTVYWAT TGTPSSFPGH T..EPGPLLI PFTLNFTITN LQYEENMGHP
 95 PGTSTVYWAT TGTPSSFPGH T..EPGPLLI PFTLNFTITN LQYEENMGHP
 71 PGTSTVDLGT SGTPSSLPSP T..SAGPLLI PFTINFTITN LRYEENMHHP
 78 PGTSTVDLRT SGTPSSLSSP TIMAAGPLLI PFTINFTITN LRYEENMHHP
115 PGTFTVQPET SETPSSLPGH T..ATGPVLL PFTLNFTIIN LQYEEDMHRP
 91 PGTSTVDVGT SGTPSSSPSP T..TAGPLLM PFTLNFTITN LQYEEDMRRT
 92 PGTSTVHLGT SETPSSLPRP IV..PGPLLI PFTLNFTITN LQYEENMGHP
113 PGTSTVDLGT SGTPSSLPSP T..TAVPLLI PFTLNFTITN LKYEEDMHCP
711 PGTSAVHLET SGTPASLPGH T..APGPLLI PFTLNFTITN LHYEENMQHP 151                                              200
910 GSRKFNTTER VLQGLLRPLF KNTSVSSLYS GCRLTLLRPE KDGAATRVDA
 99 GSRKFNTTER VLQGLLKPLF KNTSVGPLYS GCRLTLFKPE KHEAATGVDA
112 GSRKFNITES VLQGLLTPLF KNSSVGPLYS GCRLISLRSE KDGAATGVDA
 95 GSRKFNITER VLQGLLNPIF KNSSVGPLYS GCRLTSLRPE KDGAATGMDA
 71 GSRKFNTMER VLQGLLKPLF KSTSVGPLYS GCRLTLLRPE KDGVATRVDA
 78 GSRKFNTMER VLQGLLMPLF KNTSVSSLYS GCRLTLLRPE KDGAATRVDA
115 GSRKFNTTER VLQGLLMPLF KNTSVGPLYS GCRLTLLRPE KQEAATGVDT
 91 GSRKFNTMES VLQGLLKPLF KNTSVGPLYS GCRLTLLRPK KDGAATGVDA
 92 GSRKFNITER VLQGLLKPLF RNSSLEYLYS GCRLTSLRPE KDSSTMAVDA
113 GSRKFNTTER VLQSLFGPMF KNTSVGPLYS GCRLTLFRSE KDGAATGVDA
711 GSRKFNTMER VLQGCLVPCS RNTNVGLLYS GCRLTLLXXX XXXXXXXXXX 201                                              250
910 ACTYRPDPKS PGLDREQLYW ELSQLTHSIT ELGPYTLDRV SLYVNGFNPR
 99 ICTLRLDPTG PGLDRERLYW ELSQLTNSVT ELGPYTLDRD SLYVNGFTHR
112 ICTHHLNPQS PGLDRERLYW QLSQMTNGIK ELGPYTLDRD SLYVNGFTHR
 95 VCLYHPNPKR PGLDREQLYC ELSQLTHSIT ELGPYSLDRD SLYVNGFTHQ
 71 ICTHRPDPKI PGLDRQQLYW ELSQLTHSIT ELGPYTLDRD SLYVNGFTQR
 78 VCTHRPDPKS PGLDRERLYW KLSQLTHGIT ELGPYTLDRN SLYVNGFTHR
115 ICTHRLDPSE PGLDREQLYW ELSQLTNSIT ELGPYTLDRD SLYVNGFTHS
 91 ICTHRLDPKS PGLNREQLYW ELSKLTNDIE EVGPYTLDRN SLYVNGFTHR
 92 ICTHRPDPED LGLDRERLYW ELSNLTNGIQ ELGPYTLDRN SLYVNGFTHR
113 ICTHRLDPKS PGVDREQLYW ELSQLTNGIK ELGPYTLDRN SLYVNGFTHQ
711 XXXXXXXXXX XXXXXXXXXX XXXXXXXXXX XXGPYTLDRN SLYVNGFTHR 251                                              300
910 SSV.PTTSTP GTSTVHLATS GTPSSLPGHT APVPLLIPFT LNFTITNLQY
 99 SSV.PTTSIP GTSAVHLETS GTPASLPGHT APGPLLIPFT LNFTITNLQY
112 SL.GLTTSTP WTSTVDLGTS GTPSPVPSPT TAGPLLIPFT LNFTITNLQY
 95 NS.VPTTSTP GTSTVYWATT GTPSSFPGHT EPGPLLIPFT LNFTITNLQY
 71 SSV.PTTSTP GTSTVQPETS ETPSSLPGPT ATGPVLLPFT LNFTIINLQY
 78 SSM.PTTSTP GTSTVDVGTS GTPSSSPSPT TAGPLLMPFT LNFTITNLQY
115 GVLCP45
    PPSIL GIFTVQPETF ETPSSLPGPT ATGPVLLPFT LNFTIINLQY
 91 SFVAP.TSTL GTSTVDLGTS GTPSSLPSPT TGVPLLIPFT LNFTITNLQY
 92 SFM.PTTSTL GTSTVDVGTS GTPSSSPSPT TAGPLLMPFT LNFTITNLQY
113 TS.APNTSTP GTSTVDLGTS GTPSSLPSPT SAGPLLVPFT LNFTITNLQY
711 SSVAP.TSTP GTSTVDLGTS GTPSSLPSPT TV.PLLVPFT LNFTITNLQY 301                                              350
910 EEDMRHPGSR KFNTMERVLQ GLLRPLFKNT SIGPLYSSCR LTLLRPEKDK
 99 EEDMRRTGSR KFNTMERVLQ GLLKPLFKST SVGPLYSGCR LTLLRPEKRG
112 EENMGHPGSR KFNIMERVLQ GLLRPVFKNT SVGPLYSGCR LTLLRPKKDG
 95 EEDMRRTGSR KFNTMERVLQ GLLKPLFKST SVGPLYSGCR LTLLRPEKHG
 71 EEDMHRPGSR KFNTTERVLQ GLLKPLFKST SVGPLYSGCR LTLLRPEKHG
 78 EEDMRRTGSR KFNTMERVLQ GLLKPLFKST SVGPLYSGCR LTLLRPEKHG
115 EEDMHRPGSR KFNTTERVLQ GLLMPLFKNT SVGPLYSGCR LTLLRPEKQE
 91 EENMGHPGSR KFNIMERVLQ GLLMPLFKNT SVSSLYSGCR LTLLRPEKDG
 92 EEDMRRTGSR KFNTMESVLQ GLLKPLFKNT SVGPLYSGCR LTLLRPKKDG
113 EEDMRRTGSR KFNTMESVLQ GLLKPLFKNT SVGPLYSGCR LTLLRPEKDG
711 GEDMRHPGSR KFNTTERVLQ GLLGPLFKNS SVGPLYSGCR LISLRSEKDG
```

TABLE 5-continued

Amino Acid Sequence for a 1200 by Repeat in the CA125 Molecule
(SEQ ID NO: 36 thru SEQ ID NO: 46)

```
          351                                                400
910  AATRVDAICT HHPDPQSPGL NREQLYWELS QLTHGITEL- ----------
 99  AATGVDTICT HRLDPLNPGL DREQLYWELS KLTRGIIELG PYLLDRGSLY
112  AATKVDAICT YRPDPKSPGL DREQLYWELS QLTHSITELG PYTLDRDSLY
 95  AATGVDAICT LRLDPTGPGL DRERLYWELS QLTNSVTELG PYTLDRDSLY
 71  AATGVDAICT LRLDPTGPGL DRERLYWELS QLTNSITELG PYTLDRDSLY
 78  AATGVDAICT LRLDPTGPGL DRERLYWELS QLTNSVTELG PYTLDRDSLY
115  AATGVDTICT HRVDPIGPGL DRERLYWELS QLTNSITELG PYTLDRDSLY
 91  AATRVVAVCT HRPDPKSPGL DRERLYWKLS QLTHGITELG PYTLDRDSLY
 92  AATGVDAICT HRLDPKSPGL NREQLYWELS KLTNDIEELG PYTLDRNSLY
113  AATGVDAICT HRLDPKSPGL NREQLYWELS KL-------- ----------
711  AATGVDAICT HHLNPQSPGL DREQLYWQLS QVTNGIKELG PYTLDRNSLY 401                                                447
910  ---------- ---------- ---------- ---------- -------
 99  VNGFTHRNFV PITSTPGTST VHLGTSEIHP SLPRPI..VP GPL----
112  VNGFTQRSSV PTTSIPGTPT VDLGTSGTPV SKPGPS..AA SP-----
 95  VNGFTHRSSV PTTSIPGTSA VHLETSGTPA SLPGHT..AP GPLL---
 71  VNGFNPWSSV PTTSTPGTST VHLATSGTPS SLPGHT..AP VPL----
 78  VNGFTHRSSV PTTSIPGTSA VHLETSGTPA SLPGHT..AP GPLLIPF
115  VNGFNPWSSV PTTSTPGTST VHLATSGTPS SLPGHT..AP VPLLIPF
 91  VNGFTHQSSM TTTRTPDTST MHLATSRTPA SLSGPT..TA SPLLIPF
 92  VNGFTHQSSV STTSTPGTST VDPRTSGTPS SLSSPTIMAA GPLLI--
113  ---------- ---------- ---------- ---------- -------
711  VNGFTHRSSG LTTSTPWTST VDLGTSGTPS PVPSPT..TA GPLLI--
```

TABLE 6

Amino Acid Sequence for a 9 Repeat Structure in the CA125
Molecule (SEQ ID NO: 47)

```
ERVLQGLLKP LFRNSSLEYL YSGCRLASLR PEKDSSAMAV DAICTHRPDP
EDLGLDRERL YWELSNLTNG IQELGPYTLD RNSLYVNGFT HRSSMPTTST
PGTSTVDVGT SGTPSSSPSP TTAGPLLMPF TLNFTITNLQ YEEDMRRTGS
RKFNTMERVL QGPLSPIFKN SSVGPLYSGC RLTSLRPEKD GAATGMDAV
CLYHPNPKRP GLDREQLYWE LSQLTHNITE LGPYSLDRDS LYVNGFTHQN
SVPTTSTPGT STVYWATTGT PSSFPGHTEP GPLLIPFTLN FTITNLQYEE
NMGHPGSRKF NITERVLQGL LNPIFKNSSV GPLYSGCRLT SLRPEKDGAA
TGMDAVCLYH PNPKRPGLDR EQLYCELSQL THNITELGPY SLDRDSLYVN
GFTHQNSVPT TSTPGTSTVY WATTGTPSSF PGHTEPGPLL IPFTLNFTIT
NLQYEEDMRR TGSRKFNTME RLVQGLLKPL FKSTSVGPLY SGCRLTLLRP
EKHGAATGVD AICTLRLDPT GPGLDRERLY WELSQLTNSV TELGPYTLDR
DSLYVNGFTH RSSVPTTSIP GTSAVHLETS GTPASLPGHT APGPLLVPFT
LNFTITNLQY EEDMRHPGSR KFNTTERVLQ GLLKPLFKST SVGPLYSGCR
LTLLRPEKRG AATGVDTICT HRLDPLNPGL DREQLYWELS KLTRGIIELG
```

TABLE 6-continued

Amino Acid Sequence for a 9 Repeat Structure in the CA125 Molecule (SEQ ID NO: 47)

```
PYLLDRGSLY VNGFTHRNFV PITSTPGTST VHLGTSETPS SLPRPIVPGP
LLIPFTLNFT ITNLQYEENM GHPGSRKFNI TERVLQGLLK PLFRNSSLEY
LYSG CRLASL RPEKDSSAMA VDAIC THRPD PEDLGLDRER LYWELSNLTN
GIQELGPYTL DRNSLYVNGF THRSSMPTTS TPGTSTVDVG TSGTPSSSPS
PTTAGPLLMP FTLNFTITNL QYEEDMRRTG SRKFNTMESV LQGLLKPLFK
NTSVGPLYSG CRLTLLRPKK DGAATGVDAI C THRLDPKSP GLNREQLYWE
LSKLTNDIEE VGPYTLDRNS LYVNGFTHRS FVAPTSTLGT STVDLGTSGT
PSSLPSPTTG VPLLIPFTLN FTITNLQYEE NMGHPGSRKF NIMERVLQGL
LSPIFKNSSV GSLYSG CRLT LLRPEKDGAA TRVDAVC THR PDPKSPGLDR
ERLYWKLSQL THGIIELGPY TLDRHSFYVN GFTHQSSMTT TRTPDTSTMH
LATSRTPASL SGPTTASPLL VLFTINFTIT NQRYEENMHH PGSRKFNTTE
RVLQGLLRPV FKNTSVGPLY SG CRLTLLRP KKDGAATKVD AIC TYRPDPK
SPGLDREQLY WELSQLTHSI TELGPYTQDR DSLYVNGFTH RSSVPTTSIP
GTSAVHLETS GTPASLP
```

TABLE 7 cDNA Genbank Accession # AK024365 Encompasses Repeat Sequences (Repeats 1 & 2) Homologous to Two Repeats Shown in Table 6 (SEQ ID NO: 48)

```
MPLFKNTSVS SLYSG CRLTL LRPEKDGAAT RVDAVC THRP DPKSPGLDRE
RLYWKLSQLT HGIIELGPYT LDRHSFYVNG FTHQSSMTTT RTPDTSTMHL
ATSRTPASLS GPTTASPLLV LFTINFTITN QRYEENMHHP GSRKFNTTER
VLQGLLRPVF KNTSVGPLYS G CRLTLLRPK KDGAATKVDA IC TYRPDPKS
PGLDREQLYW ELSQLTHSIT ELGPYTQDRD SLYVNGFTHR SSVPTTSIPG
TSAVHLETSG TPASLPGPSA ASPLLVLFTL NFTITNLRYE ENMQHPGSRK
FNTTERVLQG LLRSLFKSTS VGPLYSG CRL TLLRPEKDGT ATGVDAIC TH
HPDPKSPRLD REQLYWELSQ LTHNITELGH YALDNDSLFV NGFTHRSSVS
TTSTPGTPTV YLGASKTPAS IFGPSAASHL LILFTLNFTI TNLRYEENMW
PGSRKFNTTE RVLQGLLRPL FKNTSVGPLY SG SRLTLLRP EKDGEATGVD
AIC THRPDPT GPGLDREQLY LELSQLTHSI TELGPYTLDR DSLYVNGFTH
RSSVPTTSTG VVSEEPFTLN FTINNLRYMA DMGQPGSLKF NITDNVMKHL
```

TABLE 7-continued cDNA Genbank Accession # AK024365 Encompasses Repeat Sequences
(Repeats 1 & 2) Homologous to Two Repeats Shown in
Table 6 (SEQ ID NO: 48)

LSPLFQRSSL GARYTC CRVI ALRSVKNGAE TRVDLLC TYL QPLSGPGLPI

KQVFHELSQQ THGITRLGPY SLDKDSLYLN GYNEPGLDEP PTTPKPATTF

LPPLSEATTA MGYHLKTLTL NFTISNLQYS PDMGKGSATF NSTEGVLQHL

LRPLFQKSSM GPFYLC CQLI SLRPEKDGAA TGVDTTC TYH PDPVGPGLDI

QQLYWELSQL THGVTQLGFY VLDRDSLFIN GYAPQNLSIR GEYQINFHIV

NWNLSNPDPT SSEYITLLRD IQDKVTTLYK GSQLHDTFRF CLVTNLTMDS

VLVTVKALFS SNLDPSLVEQ VFLDKTLNAS FHWLGSTYQL VDIHVTEMES

SVYQPTSSSS TQHFYLNFTI TNLPYSQDKA QPGTTNYQRN KRNIEDALNQ

LFRNSSIKSY FSDCQVSTFR SVPNRHHTGV DSLCNFSPLA RRVDRVAIYE

EFLRMTRNGT QLQNFTLDRS SVLVDGYSPN RNEPLTGNSD LPFWAVILIG

LAGLLGLITC LICGVLVTTR RRKKEGEYNV QQQCPGYYQS HLDLEDLQ

TABLE 8

Complete DNA Sequence for 13 Repeats including
the Carboxy Terminus of CA125

(SEQ ID NO: 49)
```
   1 GAGAGGGTTC TGCAGGGTCT GCTCAAACCC TTGTTCAGGA ATAGCAGTCT
  51 GGAATACCTC TATTCAGGCT GCAGACTAGC CTCACTCAGG CCAGAGAAGG
 101 ATAGCTCAGC CATGGCAGTG GATGCCATCT GCACACATCG CCCTGACCCT
 151 GAAGACCTCG GACTGGACAG AGAGCGACTG TACTGGGAGC TGAGCAATCT
 201 GACAAATGGC ATCCAGGAGC TGGGCCCCTA CACCCTGGAC CGGAACAGTC
 251 TCTATGTCAA TGGTTTCACC CATCGAAGCT CTATGCCCAC CACCAGCACT
 301 CCTGGGACCT CCACAGTGGA TGTGGGAACC TCAGGGACTC CATCCTCCAG
 351 CCCCAGCCCC ACGACTGCTG GCCCTCTCCT GATGCCGTTC ACCCTCAACT
 401 TCACCATCAC CAACCTGCAG TACGAGGAGG ACATGCGTCG CACTGGCTCC
 451 AGGAAGTTCA ACACCATGGA GAGGGTTCTG CAGGGTCCGC TTAGTCCCAT
 501 ATTCAAGAAC TCCAGTGTTG GCCCTCTGTA CTCTGGCTGC AGACTGACCT
 551 CTCTCAGGCC CGAGAAGGAT GGGGCAGCAA CTGGAATGGA TGCTGTCTGC
 601 CTCTACCACC CTAATCCCAA AGACCTGGG CTGGACAGAG AGCAGCTGTA
 651 CTGGGAGCTA AGCCAGCTGA CCCACAACAT CACTGAGCTG GCCCCTACA
 701 GCCTGGACAG GGACAGTCTC TATGTCAATG GTTTCACCCA TCAGAACTCT
 751 GTGCCCACCA CCAGTACTCC TGGGACCTCC ACAGTGTACT GGGCAACCAC
 801 TGGGACTCCA TCCTCCTTCC CCGGCCACAC AGAGCCTGGC CCTCTCCTGA
 851 TACCATTCAC GCTCAACTTC ACCATCACTA ACCTACAGTA TGAGGAGAAC
 901 ATGGGTCACC CTGGCTCCAG GAAGTTCAAC ATCACGGAGA GGGTTCTGCA
 951 GGGTCTGCTT AATCCCATTT TCAAGAACTC CAGTGTTGGC CCTCTGTACT
1001 CTGGCTGCAG ACTGACCTCT CTCAGGCCCG AGAAGGATGG GGCAGCAACT
1051 GGAATGGATG CTGTCTGCCT CTACCACCCT AATCCCAAAA GACCTGGGCT
1101 GGACAGAGAG CAGCTGTACT GCGAGCTAAG CCAGCTGACC CACAACATCA
```

TABLE 8-continued

Complete DNA Sequence for 13 Repeats including the Carboxy Terminus of CA125

```
1151 CTGAGCTGGG CCCCTACAGC TTGGACAGGG ACAGTCTTTA TGTCAATGGT
1201 TTCACCCATC AGAACTCTGT GCCCACCACC AGTACTCCTG GGACCTCCAC
1251 AGTGTACTGG GCAACCACTG GGACTCCATC CTCCTTCCCC GGCCACACAG
1301 AGCCTGGCCC TCTCCTGATA CCATTCACCC TCAACTTCAC CATCACCAAC
1351 CTGCAGTACG AGGAGGACAT GCGTCGCACT GGCTCCAGGA AGTTCAACAC
1401 CATGGAGAGG GTTCTGCAGG GTCTGCTCAA GCCCTTGTTC AAGAGCACCA
1451 GCGTTGGCCC TCTGTACTCT GGCTGCAGAC TGACCTTGCT CAGACCTGAG
1501 AAACATGGGG CAGCCACTGG AGTGGACGCC ATCTGCACCC TCCGCCTTGA
1551 TCCCACTGGT CCTGGACTGG ACAGAGAGCG GCTATACTGG GAGCTGAGCC
1601 AGCTGACCAA CAGCGTTACA GAGCTGGGCC CCTACACCCT GGACAGGGAC
1651 AGTCTCTATG TCAATGGCTT CACCCATCGG AGCTCTGTGC AACCACCAG
1701 TATTCCTGGG ACCTCTGCAG TGCACCTGGA AACCTCTGGG ACTCCAGCCT
1751 CCCTCCCTGG CCACACAGCC CCTGGCCCTC TCCTGGTGCC ATTCACCCTC
1801 AACTTCACTA TCACCAACCT GCAGTATGAG GAGGACATGC GTCACCCTGG
1851 TTCCAGGAAG TTCAACACCA CGGAGAGAGT CCTGCAGGGT CTGCTCAAGC
1901 CCTTGTTCAA GAGCACCAGT GTTGGCCCTC TGTACTCTGG CTGCAGACTG
1951 ACCTTGCTCA GGCCTGAAAA ACGTGGGGCA GCCACCGGCG TGGACACCAT
2001 CTGCACTCAC CGCCTTGACC CTCTAAACCC TGGACTGGAC AGAGAGCAGC
2051 TATACTGGGA GCTGAGCAAA CTGACCCGTG GCATCATCGA GCTGGGCCCC
2101 TACCTCCTGG ACAGAGGCAG TCTCTATGTC AATGGTTTCA CCCATCGGAA
2151 CTTTGTGCCC ATCACCAGCA CTCCTGGGAC CTCCACAGTA CACCTAGGAA
2201 CCTCTGAAAC TCCATCCTCC CTACCTAGAC CCATAGTGCC TGGCCCTCTC
2251 CTGATACCAT TCACACTCAA CTTCACCATC ACTAACCTAC AGTATGAGGA
2301 GAACATGGGT CACCCTGGCT CCAGGAAGTT CAACATCACG GAGAGGGTTC
2351 TGCAGGGTCT GCTCAAACCC TTGTTCAGGA ATAGCAGTCT GGAATACCTC
2401 TATTCAGGCT GCAGACTAAC CTCACTCAGG CCAGAGAAGG ATAGCTCAAC
2451 CATGGCAGTG GATGCCATCT GCACACATCG CCCTGACCCT GAAGACCTCG
2501 GACTGGACAG AGAGCGACTG TACTGGGAGC TGAGCAATCT GACAAATGGC
2551 ATCCAGGAGC TGGGCCCCTA CACCCTGGAC CGGAACAGTC TCTATGTCAA
2601 TGGTTTCACC CATCGAAGCT CTATGCCCAC CACCAGCACT CCTGGGACCT
2651 CCACAGTGGA TGTGGGAACC TCAGGGACTC CATCCTCCAG CCCCAGCCCC
2701 ACGACTGCTG GCCCTCTCCT GATGCCGTTC ACCCTCAACT TCACCATCAC
2751 CAACCTGCAG TACGAGGAGG ACATGCGTCG CACTGGCTCC AGGAAGTTCA
2801 ACACCATGGA GAGTGTCCTG CAGGGTCTGC TCAAGCCCTT GTTCAAGAAC
2851 ACCAGTGTTG GCCCTCTGTA CTCTGGCTGC AGATTGACCT TGCTCAGGCC
2901 CAAGAAAGAT GGGGCAGCCA CTGGAGTGGA TGCCATCTGC ACCCACCGCC
2951 TTGACCCCAA AGCCCTGGA CTCAACAGGG AGCAGCTGTA CTGGGAGTTA
3001 AGCAAACTGA CCAATGACAT TGAAGAGGTG GGCCCCTACA CCTTGGACAG
3051 GAACAGTCTC TATGTCAATG GTTTCACCCA TCGGAGCTTT GTGGCCCCCA
```

TABLE 8-continued

Complete DNA Sequence for 13 Repeats including
the Carboxy Terminus of CA125

```
3101 CCAGCACTCT TGGGACCTCC ACAGTGGACC TTGGGACCTC AGGGACTCCA
3151 TCCTCCCTCC CCAGCCCCAC AACAGGTGTT CCTCTCCTGA TACCATTCAC
3201 ACTCAACTTC ACCATCACTA ACCTACAGTA TGAGGAGAAC ATGGGTCACC
3251 CTGGCTCCAG GAAGTTCAAC ATCATGGAGA GGGTTCTGCA GGGTCTGCTT
3301 ATGCCCTTGT TCAAGAACAC CAGTGTCAGC TCTCTGTACT CTGGTTGCAG
3351 ACTGACCTTG CTCAGGCCTG AGAAGGATGG GGCAGCCACC AGAGTGGTTG
3401 CTGTCTGCAC CCATCGTCCT GACCCCAAAA GCCCTGGACT GGACAGAGAG
3451 CGGCTGTACT GGAAGCTGAG CCAGCTGACC CACGGCATCA CTGAGCTGGG
3501 CCCCTACACC CTGGACAGGC ACAGTCTCTA TGTCAATGGT TTCACCCATC
3551 AGAGCTCTAT GACGACCACC AGAACTCCTG ATACCTCCAC AATGCACCTG
3601 GCAACCTCGA GAACTCCAGC CTCCCTGTCT GGACCTACGA CCGCCAGCCC
3651 TCTCCTGATA CCATTCACAA TTAACTTCAC CATCACTAAC CTGCGGTATG
3701 AGGAGAACAT GCATCACCCT GGCTCTAGAA AGTTTAACAC CACGGAGAGA
3751 GTCCTTCAGG GTCTGCTCAG GCCTGTGTTC AAGAACACCA GTGTTGGCCC
3801 TCTGTACTCT GGCTGCAGAC TGACCTTGCT CAGGCCCAAG AAGGATGGGG
3851 CAGCCACCAA AGTGGATGCC ATCTGCACCT ACCGCCCTGA TCCCAAAAGC
3901 CCTGGACTGG ACAGAGAGCA GCTATACTGG GAGCTGAGCC AGCTAACCCA
3951 CAGCATCACT GAGCTGGGCC CCTACACCCT GGACAGGGAC AGTCTCTATG
4001 TCAATGGTTT CACACAGCGG AGCTCTGTGC CCACCACTAG CATTCCTGGG
4051 ACCCCCACAG TGGACCTGGG AACATCTGGG ACTCCAGTTT CTAAACCTGG
4101 TCCCTCGGCT GCCAGCCCTC TCCTGGTGCT ATTCACTCTC AACTTCACCA
4151 TCACCAACCT GCGGTATGAG GAGAACATGC AGCACCCTGG CTCCAGGAAG
4201 TTCAACACCA CGGAGAGGGT CCTTCAGGGC CTGCTCAGGT CCCTGTTCAA
4251 GAGCACCAGT GTTGGCCCTC TGTACTCTGG CTGCAGACTG ACTTTGCTCA
4301 GGCCTGAAAA GGATGGGACA GCCACTGGAG TGGATGCCAT CTGCACCCAC
4351 CACCCTGACC CCAAAAGCCC TAGGCTGGAC AGAGAGCAGC TGTATTGGGA
4401 GCTGAGCCAG CTGACCCACA ATATCACTGA GCTGGGCCAC TATGCCCTGG
4451 ACAACGACAG CCTCTTTGTC AATGGTTTCA CTCATCGGAG CTCTGTGTCC
4501 ACCACCAGCA CTCCTGGGAC CCCCACAGTG TATCTGGGAG CATCTAAGAC
4551 TCCAGCCTCG ATATTTGGCC CTTCAGCTGC CAGCCATCTC CTGATACTAT
4601 TCACCCTCAA CTTCACCATC ACTAACCTGC GGTATGAGGA GAACATGTGG
4651 CCTGGCTCCA GGAAGTTCAA CACTACAGAG AGGGTCCTTC AGGGCCTGCT
4701 AAGGCCCTTG TTCAAGAACA CCAGTGTTGG CCCTCTGTAC TCTGGCTCCA
4751 GGCTGACCTT GCTCAGGCCA GAGAAAGATG GGAAGCCAC CGGAGTGGAT
4801 GCCATCTGCA CCCACCGCCC TGACCCCACA GGCCCTGGGC TGGACAGAGA
4851 GCAGCTGTAT TTGGAGCTGA GCCAGCTGAC CCACAGCATC ACTGAGCTGG
4901 GCCCCTACAC ACTGGACAGG GACAGTCTCT ATGTCAATGG TTTCACCCAT
4951 CGGAGCTCTG TACCCACCAC CAGCACCGGG GTGGTCAGCG AGGAGCCATT
```

TABLE 8-continued

Complete DNA Sequence for 13 Repeats including the Carboxy Terminus of CA125

```
5001 CACACTGAAC TTCACCATCA ACAACCTGCG CTACATGGCG GACATGGGCC

5051 AACCCGGCTC CCTCAAGTTC AACATCACAG ACAACGTCAT GAAGCACCTG

5101 CTCAGTCCTT TGTTCCAGAG GAGCAGCCTG GGTGCACGGT ACACAGGCTG

5151 CAGGGTCATC GCACTAAGGT CTGTGAAGAA CGGTGCTGAG ACACGGGTGG

5201 ACCTCCTCTG CACCTACCTG CAGCCCCTCA GCGGCCCAGG TCTGCCTATC

5251 AAGCAGGTGT TCCATGAGCT GAGCCAGCAG ACCCATGGCA TCACCCGGCT

5301 GGGCCCCTAC TCTCTGGACA AGACAGCCT CTACCTTAAC GGTTACAATG

5351 AACCTGGTCT AGATGAGCCT CCTACAACTC CCAAGCCAGC CACCACATTC

5401 CTGCCTCCTC TGTCAGAAGC CACAACAGCC ATGGGGTACC ACCTGAAGAC

5451 CCTCACACTC AACTTCACCA TCTCCAATCT CCAGTATTCA CCAGATATGG

5501 GCAAGGGCTC AGCTACATTC AACTCCACCG AGGGGGTCCT TCAGCACCTG

5551 CTCAGACCCT TGTTCCAGAA GAGCAGCATG GGCCCCTTCT ACTTGGGTTG

5601 CCAACTGATC TCCCTCAGGC CTGAGAAGGA TGGGGCAGCC ACTGGTGTGG

5651 ACACCACCTG CACCTACCAC CCTGACCCTG TGGGCCCCGG GCTGGACATA

5701 CAGCAGCTTT ACTGGGAGCT GAGTCAGCTG ACCCATGGTG TCACCCAACT

5751 GGGCTTCTAT GTCCTGGACA GGGATAGCCT CTTCATCAAT GGCTATGCAC

5801 CCCAGAATTT ATCAATCCGG GGCGAGTACC AGATAAATTT CCACATTGTC

5851 AACTGGAACC TCAGTAATCC AGACCCCACA TCCTCAGAGT ACATCACCCT

5901 GCTGAGGGAC ATCCAGGACA AGGTCACCAC ACTCTACAAA GGCAGTCAAC

5951 TACATGACAC ATTCCGCTTC TGCCTGGTCA CCAACTTGAC GATGGACTCC

6001 GTGTTGGTCA CTGTCAAGGC ATTGTTCTCC TCCAATTTGG ACCCCAGCCT

6051 GGTGGAGCAA GTCTTTCTAG ATAAGACCCT GAATGCCTCA TTCCATTGGC

6101 TGGGCTCCAC CTACCAGTTG GTGGACATCC ATGTGACAGA AATGGAGTCA

6151 TCAGTTTATC AACCAACAAG CAGCTCCAGC ACCCAGCACT TCTACCCGAA

6201 TTTCACCATC ACCAACCTAC ATATTCCCA GGACAAAGCC CAGCCAGGCA

6251 CCACCAATTA CCAGAGGAAC AAAAGGAATA TTGAGGATGC GCTCAACCAA

6301 CTCTTCCGAA ACAGCAGCAT CAAGAGTTAT TTTTCTGACT GTCAAGTTTC

6351 AACATTCAGG TCTGTCCCCA ACAGGCACCA CACCGGGGTG GACTCCCTGT

6401 GTAACTTCTC GCCACTGGCT CGGAGAGTAG ACAGAGTTGC CATCTATGAG

6451 GAATTTCTGC GGATGACCCG GAATGGTACC CAGCTGCAGA ACTTCACCCT

6501 GGACAGGAGC AGTGTCCTTG TGGATGGGTA TTCTCCCAAC AGAAATGAGC

6551 CCTTAACTGG GAATTCTGAC CTTCCCTTCT GGGCTGTCAT CTTCATCGGC

6601 TTGGCAGGAC TCCTGGGACT CATCACATGC CTGATCTGCG GTGTCCTGGT

6651 GACCACCCGC CGGCGGAAGA AGGAAGGAGA ATACAACGTC CAGCAACAGT

6701 GCCCAGGCTA CTACCAGTCA CACCTAGACC TGGAGGATCT GCAATGACTG

6751 GAACTTGCCG GTGCCTGGGG TGCCTTTCCC CAGCCAGGG TCCAAAGAAG

6801 CTTGGCTGGG GCAGAAATAA ACCATATTGG TCG
```

TABLE 9

Complete Amino Acid Sequence for 13 Repeats Contiguous with the Carboxy Terminus of CA125 (SEQ ID NO: 50)

```
                             1
ERVLQGLLKP LFRNSSLEYL YSGCRLASLR PEKDSSAMAV DAICTHRPDP

EDLGLDRERL YWELSNLTNG IQELGPYTLD RNSLYVNGFT HRSSMPTTST

PGTSTVDVGT SGTPSSSPSP TTAGPLLMPF TLNFTITNLQ YEEDMRRTGS

2
RKFNTMERVL QGPLSPIFKN SSVGPLYSGC RLTSLRPEKD GAATGMDAVC

LYHPNPKRPG LDREQLYWEL SQLTHNITEL GPYSLDRDSL YVNGFTHQNS

VPTTSTPGTS TVYWATTGTP SSFPGHTEPG PLLIPFTLNF TITNLQYEEN

3
MGHPGSRKFN ITERVLQGLL NPIFKNSSVG PLYSGCRLTS LRPEKDGAAT

GMDAVCLYHP NPKRPGLDRE QLYCELSQLT HNITELGPYS LDRDSLYVNG

FTHQNSVPTT STPGTSTVYW ATTGTPSSFP GHTEPGPLLI PFTLNFTITN

4
LQYEEDMRRT GSRKFNTMER VLQGLLKPLF KSTSVGPLYS GCRLTLLRPE

KHGAATGVDA ICTLRLDPTG PGLDRERLYW ELSQLTNSVT ELGPYTLDRD

SLYVNGFTHR SSVPTTSIPG TSAVHLETSG TPASLPGHTA PGPLLVPFTL

NFTITNLQYE EDMRHPGSRK FNTTERVLQG LLKPLFKSTS VGPLYSGCRL

5
TLLRPEKRGA ATGVDTICTH RLDPLNPGLD REQLYWELSK LTRGIIELGP

YLLDRGSLYV NGFTHRNFVP ITSTPGTSTV HLGTSETPSS LPRPIVPGPL

LIPFTLNFTI TNLQYEENMG HPGSRKFNIT ERVLQGLLKP LFRNSSLEYL

6
YSGCRLASLR PEKDSSAMAV DAICTHRPDP EDLGLDRERL YWELSNLTNG

IQELGPYTLD RNSLYVNGFT HRSSMPTTST PGTSTVDVGT SGTPSSSPSP

TTAGPLLMPF TLNFTITNLQ YEEDMRRTGS RKFNTMESVL QGLLKPLFKN

7
TSVGPLYSGC RLTLLRPKKD GAATGVDAIC THRLDPKSPG LNREQLYWEL

SKLTNDIEEV GPYTLDRNSL YVNGFTHRSF VAPTSTLGTS TVDLGTSGTP

SSLPSPTTGV PLLIPFTLNF TITNLQYEEN MGHPGSRKFN IMERVLQGLL

8
SPIFKNSSVG SLYSGCRLTL LRPEKDGAAT RVDAVCTHRP DPKSPGLDRE

RLYWKLSQLT HGIIELGPYT LDRHSFYVNG FTHQSSMTTT RTPDTSTMHL

ATSRTPASLS GPTTASPLLV LFTINFTITN QRYEENMHHP GSRKFNTTER

9
VLQGLLRPVF KNTSVGPLYS GCRLTLLRPK KDGAATKVDA ICTYRPDPKS

PGLDREQLYW ELSQLTHSIT ELGPYTQDRD SLYVNGFTHR SSVPTTSIPG

TSAVHLETSG TPASLPGPSA ASPLLVLFTL NFTITNLRYE ENMQHPGSRK

10
FNTTERVLQG LLRSLFKSTS VGPLYSGCRL TLLRPEKDGT ATGVDAICTH

HPDPKSPRLD REQLYWELSQ LTHNITELGH YALDNDSLFV NGFTHRSSVS

TTSTPGTPTV YLGASKTPAS IFGPSAASHL LILFTLNFTI TNLRYEENMW
```

TABLE 9-continued

Complete Amino Acid Sequence for 13 Repeats Contiguous with
the Carboxy Terminus of CA125 (SEQ ID NO: 50)

```
                                            11
PGSRKFNTTE RVLQGLLRPL FKNTSVGPLY SGSRLTLLRP EKDGEATGVD

AICTHRPDPT GPGLDREQLY LELSQLTHSI TELGPYTLDR DSLYVNGFTH

RSSVPTTSTG VVSEEPFTLN FTINNLRYMA DMGQPGSLKF NITDNVMKHL

12
LSPLFQRSSL GARYTGCRVI ALRSVKNGAE TRVDLLCTYL QPLSGPGLPI

KQVFHELSQQ THGITRLGPY SLDKDSLYLN GYNEPGLDEP PTTPKPATTF

LPPLSEATTA MGYHLKTLTL NFTISNLQYS PDMGKGSATF NSTEGVLQHL

13
LRPLFQKSSM GPFYLGCQLI SLRPEKDGAA TGVDTTCTYH PDPVGPGLDI

QQLYWELSQL THGVTQLGFY VLDRDSLFIN GYAPQNLSIR GEYQINFHIV

NWNLSNPDPT SSEYITLLRD IQDKVTTLYK GSQLHDTFRF CLVTNLTMDS

VLVTVKALFS SNLDPSLVEQ VFLDKTLNAS FHWLGSTYQL VDIHVTEMES

SVYQPTSSSS TQHFYLNFTI TNLPYSQDKA QPGTTNYQRN KRNIEDALNQ

LFRNSSIKSY FSDCQVSTFR SVPNRHHTGV DSLCNFSPLA RRVDRVAIYE

EFLRMTRNGT QLQNFTLDRS SVLVDGYSPN RNEPLTGNSD LPFWAVILIG

LAGLLGLITC LICGVLVTTR RRKKEGEYNV QQQCPGYYQS HLDLEDLQ
```

TABLE 10A

5' Primer Sequence for End of the Open Reading Frame for Contig #32 of Chromosome 19 Cosmid AC008734 (SEQ ID NO: 51), Primer Sequence from within the Repeat Region (SEQ ID NO: 52, 3 Primer Sets Synthesized to Piece Together Entire Open Reading Frame in Contig #32 (SEQ ID NOS: 53 thru 58), Primers to Cosmid No. AC008734 for Contig #32 (SEQ ID NOS: 59 and 60), Sense Primer Sequence (supplied by Ambion) (SEQ ID NO: 61), Anti-Sense Primer Sequence for CA125 (SEQ ID NO: 62), and 5' Sense Primer Sequence (from Ambion) (SEQ ID NO: 63) and Anti-Sense Primer Specific to CA125 (SEQ ID NO: 64)

| | |
|---|---|
| (SEQ ID NO: 51) | (5'-CAGCAGAGACCAGCACGAGTACTC-3') |
| (SEQ ID NO: 52) | (5'-TCCACTGCCATGGCTGAGCT-3') |
| Primer Sets | |
| (SEQ ID NO: 53) | (Set 1) 5'-CCAGCACAGCTCTTCCCAGGAC-3' |
| (SEQ ID NO: 54) | 5'-GGAATGGCTGAGCTGACGTCTG-3') |
| (SEQ ID NO: 55) | (Set 2) 5'-CTTCCCAGGACAACCTCAAGG-3' |
| (SEQ ID NO: 56 | 5'-GCAGGATGAGTGAGCCACGTG-3' |
| (SEQ ID NO: 57) | (Set 3) 5'-GTCAGATCTGGTGACCTCACTG-3' |
| (SEQ ID NO: 58) | 5'-GAGGCACTGGAAAGCCCAGAG-3' |
| (SEQ ID NO: 59) | 5'-CTGATGGCATTATGGAACACATCAC-3' |
| (SEQ ID NO: 60) | 5'-CCCAGAACGAGAGACCAGTGAG-3' |
| (SEQ ID NO: 61) | 5'-GCTGATGGCGATGAATGAACACTG-3' |
| (SEQ ID NO: 62) | 5'-CCCAGAACGAGAGACCAGTGAG-3' |
| (SEQ ID NO: 63) | 5'-CGCGGATCCGAACACTGCGTTTGCTGGCTTTGATG-3' |
| (SEQ ID NO: 64) | 5'-CCTCTGTGTGCTGCTTCATTGGG-3' |

TABLE 10B

Sense and Anti-Sense Primers Used to Order the CA125 Carboxy Terminal Domain (SEQ. ID NO: 303 and SEQ ID NO: 304, respectively)

(SEQ ID NO: 303)   5'-GGACAAGGTCACCACACTCTAC-3'

(SEQ ID NO: 304)   5'-GCAGATCCTCCAGGTCTAGGTGTG-3'

TABLE 10C

Sense and Anti-Sense Primers Used to Amplify Overlapping Sequences in the Repeat Domain (SEQ ID NO: 305 and SEQ ID NO: 306, respectively)

(SEQ ID NO: 305)
5' GTC TCT ATG TCA ATG GTT TCA CCC-3'

(SEQ ID NO: 306)
5'-TAG CTG CTC TCT GTC CAG TCC-3'

TABLE 11

5' Sense Primer 1 Sequence and 3' Antisense Primer 2 (SEQ ID NO: 65 and SEQ ID NO: 66, respectively), and Nucleotide and Amino Acid Sequences of the CA125 Repeat Expressed in *E. coli* (SEQ ID NO: 67 and SEQ ID NO: 68, respectively)

(SEQ ID NO: 65)   5'-ACCGGATCCATGGGCCACACAGAGCCTGGCCC-3'

(SEQ ID NO: 66)   5'-TGTAAGCTTAGGCAGGGAGGATGGAGTCC-3'

(SEQ ID NO: 67)
```
  1 ATGAGAGGAT CGCATCACCA TCACCATCAC GGATCCATGG GCCACACAGA
                                                        ↑
 51 GCCTGGCCCT CTCCTGATAC CATTCACTTT CAACTTTACC ATCACCAACC
101 TGCATTATGA GGAAAACATG CAACACCCTG GTTCCAGGAA GTTCAACACC
151 ACGGAGAGGG TTCTGCAGGG TCTGCTCAAG CCCTTGTTCA AGAACACCAG
201 TGTTGGCCCT CTGTACTCTG GCTGCAGACT GACCTTGCTC AGACCTGAGA
251 AGCATGAGGC AGCCACTGGA GTGGACACCA TCTGTACCCA CCGCGTTGAT
301 CCCATCGGAC TGGACTGGA CAGAGAGCGG CTATACTGGG AGCTGAGCCA
351 GCTGACCAAC AGCATCACAG AGCTGGGACC CTACACCCTG GACAGGGACA
401 GTCTCTATGT CAATGGCTTC AACCCTCGGA GCTCTGTGCC AACCACCAGC
451 ACTCCTGGGA CCTCCACAGT GCACCTGGCA ACCTCTGGGA CTCCATCCTC
501 CCTGCCT
```

(SEQ ID NO: 68)
M R G S H H H H H H G S M G H T E P G P L L I P F T F N F T I T N L

H Y E E N M Q H P G S R K F N T T E R V L Q G L L K P L F K N T S V

G P L Y S G C R L T L L R P E K H E A A T G V D T I C T H R V D P I

G P G L D R E R L Y W E L S Q L T N S I T E L G P Y T L D R D S L Y

V N G F N P R S S V P T T S T P G T S T V H L A T S G T P S S L P

TABLE 12

Additional Multiple Repeat Amino Acid Sequences (SEQ ID NO: 69 thru SEQ ID NO: 80)

(SEQ ID NO: 69)
ERVLQGLLGP MFKNTSVGLL YSGCRLTLLR PKKDGAATKV

DAICTYRPDP KSPGLDREQL YWELSQLTHS ITELGPYTLD

RDSLYVNGFT QRSSVPTTSI PGTPTVDLGT SGTPVSKPGP

SAASPLLIPF TINFTITNLR YEENMGHPGS RKFNIMERVL

QGLLKPLFKN TSVGPLYSGC RLTLLRPKKD GAATGVDAIC

THRLDPKSPG LNREQLYWEL SKLTNDIEEL GPYTLDRNSL

YVNGFTHQSS VSTTSTPGTS TVDLRTSGTP SSLSSPTIMA

AGPLLIPFTI NFTITNLRYE ENMHHPGSRK FNTMERVLQG

LLMPLFKNTS VSSLYSGCRL TLLRPEKDGA ATRVDAVCTH

TABLE 12-continued

Additional Multiple Repeat Amino Acid Sequences
(SEQ ID NO: 69 thru SEQ ID NO: 80)

RPDPKSPGLD RERLYWKLSQ LTHGITELGP YTLDRNSLYV

NGFTHRSSMP TTSTPGTSTV DVGTSGTPSS SPSPTTAGPL

LMPFTLNFTI TNLQYEEDMR RTGSRKFNTM ERVLQGLLKP

LFKSTSVGPL YSGCRLTLLR PEKHGAATGV DAICTLRLDP

TGPGLDRERL YWELSQLTNS VTELGPYTLD RDSLYVNGFT

HRSSVPTTSI PGTSAVHLET SGTPASLPGH TAPGPLLIPF

TLNFTITNLH YEENMQHPGS RKFNTMERVL QGCLVPCSRN

TNVGLLYSGC RLTLLRXEKX XAATXVDXXC XXXXDPXXPG

LDREXLYWEL SXLTXXIXEL GPYTLDRNSL YVNGFTHRSS

VAPTSTPGTS TVDLGTSGTP SSLPSPTTVP LLVPFTLNFT

ITNLQYGEDM RHPGSRKFNT TERVLQGLLG PLFKNSSVGP

LYSGCRLISL RSEKDGAATG VDAICTHHLN PQSPGLDREQ

LYWQLSQVTN GIKELGPYTL DRNSLYVNGF THRSSGLTTS

TPWTSTVDLG TSGTPSPVPS PTTAGPLLI (SEQ ID NO: 70)
QGLLGPMFKN TSVGLLYSGC RLTLLRPEKR GAATGVDTIC

THRLDPLNPG LDREQLYWEL SKLTRGIIEL GPYLLDRGSL

YVNGFTHRNF VPITSTPGTS TVHLGTSETP SSLPRPIVPG

PLLVPFTLNF TITNLQYEEA MRHPGSRKFN TTERVLQGLL

RPLFKNTSVS SLYSGCRLTL LRPEKDGAAT RVDAACTYRP

DPKSPGLDRE QLYWELSQLT HSITELGPYT LDRVSLYVNG

FNPRSSVPTT STPGTSTVHL ATSGTPSSLP GHTAPVPLLI

PFTLNFTITN LQYEEDMRHP GSRKFNTMER VLQGLLRPLF

KNTSIGPLYS SCRLTLLRPE KDKAATRVDA ICTHHPDPQS

PGLNREQLYW ELSQLTHGIT ELGPYTLDRD SLYVDGFTHW

SPIPTTSTPG TSIVNLGTSG IPPSLPETTA TGPLLIPFTP

NFTITNLQYE EDMRRTGSRK FNTMERVLQG LLSPIFKNSS

VGPLYSGCRL TSLRPEKDGA ATGMDAVCLY HPNPKRPGLD REQLY (SEQ ID NO: 71)
ERVLQGLLKP LFKSTSVGPL YSGCRLTLLR PEKDGVATRV

DAICTHRPDP KIPGLDRQQL YWELSQLTHS ITELGPYTLD

RDSLYVNGFT QRSSVPTTST PGTFTVQPET SETPSSLPGP

TATGPVLLPF TLNFTIINLQ YEEDMHRPGS RKFNTTERVL

QGLLMPLFKN TSVGPLYSGC RLTLLRPEKQ EAATGVDTIC

THRLDPSEPG LDREQLYWEL SQLTNSITEL GPYTLDRDSL

YVNGFTHSGV LCPPPSILGI FTVQPETFET PSSLPGPTAT

GPVLLPFTLN FTIINLQYEE DMHRPGSRKF NTTERVLQGL

LTPLFKNTSV GPLYSGCRLT LLRPEKQEAA TGVDTICTHR

VDPIGPGLDR ERLYWELSQL TNSITELGPY TLDRDSLYVN

GFNPWSSVPT TSTPGTSTVH LATSGTPSSL PGHTAPVPLL

IPFTLNFTIT NLHYEENMQH PGSRKFNTTE RVLQGLLKPL

FKSTSVGPLY SGCRLTLLRP EKHGAATGVD AICTHRLDPK

SPGVDREQLY WELSQLTNGI KELGPYTLDR NSLYVNGFTH

WIPVPTSSTP GTSTVDLGSG TPSSLPSPTT AGPL (SEQ ID NO: 72)
TSVGPLYSGC RLTLLRSEKD GAATGVDAIY THRLDPKSPG

VDREQLYWEL SQLTNGIKEL GPYTLDRNSL YVNGFTHQTS

APNTSTPGTS TVDLGTSGTP SSLPSPTSAG PLLIPFTINF

TITNLRYEEN MHHPGSRKFN TMERVLQGLL KPLFKSTSVG

PLYSGCRLTL LRPEKDGVAT RVDAICTHRP DPKIPGLDRQ

QLYWELSQLT HSITELGPYT LDRDSLYVNG FTQRSSVPTT

STPGTFTVQP ETSETPSSLP GPTATGPVLL PFTLNFTIIN

LQYEEDMHRP GSRKFNTTER VLQGLLKPLF KSTSVGPLYS

GCRLTLLRPE KHGAATGVDA ICTLRLDPTG PGLDRERLYW

ELSQLTNSIT ELGPYTLDRD SLYVNGFNPW SSVPTTSTPG

TSTVHLATSG TPSSLPGHTA PVPL (SEQ ID NO: 73)
ERVLQGLLKP LFKSTSVGPL YSGCRLTLLR PEKRGAATGV

DTICTHRLDP LNPGLDREQL YWELSKLTRG IIELGPYLLD

RDSLYVNGFT HRSSVPTTSI PGTSAVHLET SGTPASLPGH

TAPGPLLVPF TLNFTITNLQ YEEDMRHPGS RKFNTTERVL

QGLLKPLFKS TSVGPLYSGC RLTLLRPEKR GAATGVDTIC

THRLDPLNPG LDREQLYWEL SKLTRGIIEL GPYLLDRGSL

YVNGFTHRNF VPITSTPGTS TVHLGTSETP SSLPRPIVPG PLLIPF (SEQ ID NO: 74)
ERVLQGLLRP VFKNTSVGPL YSGCRLTLLR PKKDGAATKV

DAICTYRPDP KSPGLDREQL YWELSQLTHS ITELGPYTLD

RDSLYVNGFT QRSSVPTTSI PGTPTVDLGT SGTPVSKPGP

SAASPLLVPF TLNFTITNLQ YEEDMHRPGS RKFNATERVL

QGLLSPIFKN SSVGPLYSGC RLTSLRPEKD GAATGMDAVC

LYHPNPKRPG LDREQLYWEL SQLTHNITEL GPYSLDRDSL

YVNGFTHQSS MTTTRTPDTS TMHLATSRTP ASLSGPTTAS PLLIPF (SEQ ID NO: 75)
ERVLQGLLKP LFKSTSVGPL YSGCRLTLLR PEKRGAATGV

DTICTHRLDP LNPGLDREQL YWELSKLTRG IIELGPYLLD

RGSLYVNGFS RQSSMTTTRT PDTSTMHLAT SRTPASLSGP

TTASPLLIPF TLNFTITNLQ YEENMGHPGS RKFNIMERVL

QGLLNPIFKN SSVGPLYSGC RLTSLKPEKD GAATGMDAVC

LYHPNPKRPG LDREQLYWEL SQLTHGIKEL GPYTLDRNSL

YVNGFTHRSS VAPTSTPGTS TVDLGTSGTP SSLPSPTTAV PLLIPF

TABLE 12-continued

Additional Multiple Repeat Amino Acid Sequences
(SEQ ID NO: 69 thru SEQ ID NO: 80)

(SEQ ID NO: 76)
ERVLQGLLKP LFRNSSLEYL YSGCRLASLR PEKDSSAMAV
DAICTHRPDP EDLGLDRERL YWELSNLTNG IQELGPYTLD
RNSLYVNGFT HRSSGLTTST PWTSTVDLGT SGTPSPVPSP
TTAGPLLIPF TLNFTITNLQ YEENMGHPGS RKFNIMERVL
QGLLMPLFKN TSVSSLYSGC RLTLLRPEKD GAATRVDAVC
TQRPDPKSPG LDRERLYWKL SQLTHGITEL GPYTLDRHSL
YVNGLTHQSS MTTTRTPDTS TMHLATSRTP ASLSGPTTAS PLLIPF (SEQ ID NO: 77)
ERVLQGLLSP ISKNSSVGPL YSGCRLTSLR PEKDGAATGM
DAVCLYHPNP KRPGLDREQL YWELSQLTHN ITELGPYSLD
RDSLYVNGFT HQNSVPTTST PGTSTVYWAT TGTPSSFPGH
TEPGPLLIPF TVNFTITNLR YEENMHHPGS RKFNTTERVL
QGLLRPVFKN TSVGPLYSGC RLTLLRPKKD GAATKVDAIC
TYRPDPKSPG LDREQLYWEL SKLTNDIEEL GPYTLDRNSL
YVNGFTHQSS VSTTSTPGTS TVDLRTSGTP SSLSSPTIMA
AGPLLIPF (SEQ ID NO: 78)
ERVLHGLLTP LFKNTRVGPL YSGCRLTLLR PEKQEAATGV
DTICTHRVDP IGPGLDRERL YWELSQLTNS ITELGPYTLD
RDSLYVNGFN PWSSVPTTST PGTSTVHLAT SGTPSSLPGH
TAPVPLLIPF TLNFTITNLH YEENMQHPGS RKFNTTERVL
QGLLKPLFKN TSVGPLYSGC RLTLFKPEKH EAATGVDAIC
TLRLDPTGPG LDRQLYWELS QLTNSVTELG PYTLDRDSLY
VNGFTHRSSV PTTSIPGTSA VHLETSGTPA SLPGHTAPGP
LLIPFTLNFT ITNLQYEEDM RRTGSRKFNT MERVLQGLLK
PLFKSTSVGP LYSGCRLTLL RPEKRGAATG VDTICTHRLD
PLNPGLDREQ LYWELSKLTR GIIELGPYLL DRGSLYVNGF
THRNFVPITS TPGTSTVHLG TSETPSSLPR PIVPGPLLIP
FTINFTITNL RYEENMHHPG SRKFNIMERV LQGLLGPLFK (SEQ ID NO: 78 continued)
NSSVGPLYSG CRLISLRSEK DGAATGVDAI CTHHLNPQSP
GLDREQLYWQ LSQMTNGIKE LGPYTLDRNS LYVNGFTHRS
SGLTTSTPWT STVDLGTSGT PSPVPSPTTA GPLLIPF (SEQ ID NO: 79)
GPLYSGCRLT SLRPEKDGAA TGMDAVCLYH PNPKRPGLDR
EQLYWELSQL THNITELGPY SLDRDSLYVN GFTHQNSVPT
TSTPGTSTVY WATTGTPSSF PGHTEPGPLL IPFTLNFTIT
NLQYEENMGH PGSRKFNITE SVLQGLLTPL FKNSSVGPLY
SGCRLISLRS EKDGAATGVD AICTHHLNPQ SPGLDREQLY
WQLSQMTNGI KELGPYTLDR DSLYVNGFTH RSLGLTTSTP
WTSTVDLGTS GTPSPVPSPT TAGPLLIPFT LNFTITNLQY
EENMGHPGSR KFNIMERVLQ GLLRPVFKNT SVGPLYSGCR
LTLLRPKKDG AATKVDAICT YRPDPKSPGL DREQLYWELS
QLTHSITELG PYTLDRDSLY VNGFTQRSSV PTTSIPGTPT
VDLGTSGTPV SKPGPSAASP (SEQ ID NO: 80)
QLYWELSKLT NDIEELGPYT LDRNSLYVNG FTHQSSVSTT
STPGTSTVDL RTSGTPSSLS SPTIMAAGPL LIPFTLNFTI
TNLQYEENMG HPGSRKFNIM ERVLQGLLGP MFKNTSVGLL
YSGCRLTLLR PEKNGAATGM DAICSHRLDP KSPGLNREQL
YWELSQLTHG IKELGPYTLD RNSLYVNGFT HRSSVAPTST
PGTSTVDLGT SGTPSSLPSP TTAVPLLIPF TLNFTITNLK
YEEDMHCPGS RKFNTTERVL QSLFGPMFKN TSVGPLYSGC
RLTLLRSEKD GAATGVDAIC THRLDPKSLG VDREQLYWEL
SQLTNGIKEL GPYTLDRNSL YVNGFTHQTS APNTSTPGTS
TVDLGTSGTP SSLPSPTSAG PLLVPFTLNF TITNLQYEED
MRRTGSRKFN TMESVLQGLL KPLFKNTSVG PLYSGCRLTL
LRPEKDGAAT GVDAICTHRL DPKSPGLNRE QLYWELSKL

TABLE 13

Amino Terminal Nucleotide Sequence
(SEQ ID NO: 81)

| | |
|---|---|
| 1 | CAGAGAGCGT TGAGCTGGGA ACAGTGACAA GTGCTTATCA AGTTCCTTCA |
| 51 | CTCTCAACAC GGTTGACAAG AACTGATGGC ATTATGGAAC ACATCACAAA |
| 101 | AATACCCAAT GAAGCAGCAC ACAGAGGTAC CATAAGACCA GTCAAAGGCC |
| 151 | CTCAGACATC CACTTCGCCT GCCAGTCCTA AGGACTACA CACAGGAGGG |
| 201 | ACAAAAAGAA TGGAGACCAC CACCACAGCT TGAAGACCA CCACCACAGC |
| 251 | TTTGAAGACC ACTTCAGAG CCACCTTGAC CACCAGTGTC TATACTCCCA |
| 301 | CTTTGGGAAC ACTGACTCCC CTCAATGCAT CAAGGCAAAT GGCCAGCACA |

TABLE 13-continued

Amino Terminal Nucleotide Sequence
(SEQ ID NO: 81)

```
 351  ATCCTCACAG AAATGATGAT CACAACCCCA TATGTTTTCC CTGATGTTCC
 401  AGAAACGACA TCCTCATTGG CTACCAGCCT GGGAGCAGAA ACCAGCACAG
 451  CTCTTCCCAG GACAACCCCA TCTGTTCTCA ATAGAGAATC AGAGACCACA
 501  GCCTCACTGG TCTCTCGTTC TGGGGCAGAG AGAAGTCCGG TTATTCAAAC
 551  TCTAGATGTT TCTTCTAGTG AGCCAGATAC AACAGCTTCA TGGGTTATCC
 601  ATCCTGCAGA GACCATCCCA ACTGTTTCCA AGACAACCCC CAATTTTTTC
 651  CACAGTGAAT TAGACACTGT ATCTTCCACA GCCACCAGTC ATGGGGCAGA
 701  CGTCAGCTCA GCCATTCCAA CAAATATCTC ACCTAGTGAA CTAGATGCAC
 751  TGACCCCACT GGTCACTATT TCGGGACAG ATACTAGTAC AACATTCCCA
 801  ACACTGACTA AGTCCCCACA TGAAACAGAG ACAAGAACCA CATGGCTCAC
 851  TCATCCTGCA GAGACCAGCT CAGCTATTCC CAGAACAATC CCCAATTTTT
 901  CTCATCATGA ATCAGATGCC ACACCTTCAA TAGCCACCAG TCCTGGGGCA
 951  GAAACCAGTT CAGCTATTCC AATTATGACT GTCTCACCTG GTGCAGAAGA
1001  TCTGGTGACC TCACAGGTCA CTAGTTCTGG GACAGACAGA AATATGACTA
1051  TTCCAACTTT GACTCTTTCT CCTGGTGAAC CAAAGACGAT AGCCTCATTA
1101  GTCACCCATC CTGAAGCACA GACAAGTTCG GCCATTCCAA CTTCAACTAT
1151  CTCGCCTGCT GTATCACGGT TGGTGACCTC AATGGTCACC AGTTTGGCGG
1201  CAAAGACAAG TACAACTAAT CGAGCTCTGA CAAACTCCCC TGGTGAACCA
1251  GCTACAACAG TTTCATTGGT CACGCATCCT GCACAGACCA GCCCAACAGT
1301  TCCCTGGACA ACTTCCATTT TTTTCCATAG TAAATCAGAC ACCACACCTT
1351  CAATGACCAC CAGTCATGGG GCAGAATCCA GTTCAGCTGT TCCAACTCCA
1401  ACTGTTTCAA CTGAGGTACC AGGAGTAGTG ACCCCTTTGG TCACCAGTTC
1451  TAGGGCAGTG ATCAGTACAA CTATTCCAAT TCTGACTCTT TCTCCTGGTG
1501  AACCAGAGAC ACACCTTCA ATGGCCACCA GTCATGGGGA AGAAGCCAGT
1551  TCTGCTATTC CAACTCCAAC TGTTTCACCT GGGGTACCAG GAGTGGTGAC
1601  CTCTCTGGTC ACTAGTTCTA GGGCAGTGAC TAGTACAACT ATTCCAATTC
1651  TGACTTTTTC TCTTGGTGAA CCAGAGACCA CACCTTCAAT GGCCACCAGT
1701  CATGGGACAG AAGCTGGCTC AGCTGTTCCA ACTGTTTTAC CTGAGGTACC
1751  AGGAATGGTG ACCTCTCTGG TTGCTAGTTC TAGGGCAGTA ACCAGTACAA
1801  CTCTTCCAAC TCTGACTCTT TCTCCTGGTG AACCAGAGAC ACACCTTCA
1851  ATGGCCACCA GTCATGGGGC AGAAGCCAGC TCAACTGTTC CAACTGTTTC
1901  ACCTGAGGTA CCAGGAGTGG TGACCTCTCT GGTCACTAGT TCTAGTGGAG
1951  TAAACAGTAC AAGTATTCCA ACTCTGATTC TTTCTCCTGG TGAACTAGAA
2001  ACCACACCTT CAATGGCCAC CAGTCATGGG GCAGAAGCCA GCTCAGCTGT
2051  TCCAACTCCA ACTGTTTCAC CTGGGGTATC AGGAGTGGTG ACCCCTCTGG
2101  TCACTAGTTC CAGGGCAGTG ACCAGTACAA CTATTCCAAT TCTAACTCTT
2151  TCTTCTAGTG AGCCAGAGAC CACACCTTCA ATGGCCACCA GTCATGGGGT
2201  AGAAGCCAGC TCAGCTGTTC TAACTGTTTC ACCTGAGGTA CCAGGAATGG
```

TABLE 13-continued

Amino Terminal Nucleotide Sequence
(SEQ ID NO: 81)

| | |
|---|---|
| 2251 | TGACCTCTCT GGTCACTAGT TCTAGAGCAG TAACCAGTAC AACTATTCCA |
| 2301 | ACTCTGACTA TTTCTTCTGA TGAACCAGAG ACCACAACTT CATTGGTCAC |
| 2351 | CCATTCTGAG GCAAAGATGA TTTCAGCCAT TCCAACTTTA GCTGTCTCCC |
| 2401 | CTACTGTACA AGGGCTGGTG ACTTCACTGG TCACTAGTTC TGGGTCAGAG |
| 2451 | ACCAGTGCGT TTTCAAATCT AACTGTTGCC TCAAGTCAAC CAGAGACCAT |
| 2501 | AGACTCATGG GTCGCTCATC CTGGGACAGA AGCAAGTTCT GTTGTTCCAA |
| 2551 | CTTTGACTGT CTCCACTGGT GAGCCGTTTA CAAATATCTC ATTGGTCACC |
| 2601 | CATCCTGCAG AGAGTAGCTC AACTCTTCCC AGGACAACCT CAAGGTTTTC |
| 2651 | CCACAGTGAA TTAGACACTA TGCCTTCTAC AGTCACCAGT CCTGAGGCAG |
| 2701 | AATCCAGCTC AGCCATTTCA ACTACTATTT CACCTGGTAT ACCAGGTGTG |
| 2751 | CTGACATCAC TGGTCACTAG CTCTGGGAGA GACATCAGTG CAACTTTTCC |
| 2801 | AACAGTGCCT GAGTCCCCAC ATGAATCAGA GGCAACAGCC TCATGGGTTA |
| 2851 | CTCATCCTGC AGTCACCAGC ACAACAGTTC CCAGGACAAC CCCTAATTAT |
| 2901 | TCTCATAGTG AACCAGACAC CACACCATCA ATAGCCACCA GTCCTGGGGC |
| 2951 | AGAAGCCACT TCAGATTTTC AACAATAAC TGTCTCACCT GATGTACCAG |
| 3001 | ATATGGTAAC CTCACAGGTC ACTAGTTCTG GGACAGACAC CAGTATAACT |
| 3051 | ATTCCAACTC TGACTCTTTC TTCTGGTGAG CCAGAGACCA CAACCTCATT |
| 3101 | TATCACCTAT TCTGAGACAC ACACAAGTTC AGCCATTCCA ACTCTCCCTG |
| 3151 | TCTCCCCTGG TGCATCAAAG ATGCTGACCT CACTGGTCAT CAGTTCTGGG |
| 3201 | ACAGACAGCA CTACAACTTT CCCAACACTG ACGGAGACCC CATATGAACC |
| 3251 | AGAGACAACA GCCATACAGC TCATTCATCC TGCAGAGACC AACACAATGG |
| 3301 | TTCCCAAGAC AACTCCCAAG TTTTCCCATA GTAAGTCAGA CACCACACTC |
| 3351 | CCAGTAGCCA TCACCAGTCC TGGGCCAGAA GCCAGTTCAG CTGTTTCAAC |
| 3401 | GACAACTATC TCACCTGATA TGTCAGATCT GGTGACCTCA CTGGTCCCTA |
| 3451 | GTTCTGGGAC AGACACCAGT ACAACCTTCC CAACATTGAG TGAGACCCCA |
| 3501 | TATGAACCAG AGACTACAGT CACGTGGCTC ACTCATCCTG CAGAAACCAG |
| 3551 | CACAACGGTT TCTGGGACAA TTCCCAACTT TTCCCATAGG GGATCAGACA |
| 3601 | CTGCACCCTC AATGGTCACC AGTCCTGGAG TAGACACGAG GTCAGGTGTT |
| 3651 | CCAACTACAA CCATCCCACC CAGTATACCA GGGGTAGTGA CCTCACAGGT |
| 3701 | CACTAGTTCT GCAACAGACA CTAGTACAGC TATTCCAACT TTGACTCCTT |
| 3751 | CTCCTGGTGA ACCAGAGACC ACAGCCTCAT CAGCTACCCA TCCTGGGACA |
| 3801 | CAGACTGGCT TCACTGTTCC AATTCGGACT GTTCCCTCTA GTGAGCCAGA |
| 3851 | TACAATGGCT TCCTGGGTCA CTCATCCTCC ACAGACCAGC ACACCTGTTT |
| 3901 | CCAGAACAAC CTCCAGTTTT TCCCATAGTA GTCCAGATGC CACACCTGTA |
| 3951 | ATGGCCACCA GTCCTAGGAC AGAAGCCAGT TCAGCTGTAC TGACAACAAT |
| 4001 | CTCACCTGGT GCACCAGAGA TGGTGACTTC ACAGATCACT AGTTCTGGGG |
| 4051 | CAGCAACCAG TACAACTGTT CCAACTTTGA CTCATTCTCC TGGTATGCCA |
| 4101 | GAGACCACAG CCTTATTGAG CACCCATCCC AGAACAGGGA CAAGTAAAAC |
| 4151 | ATTTCCTGCT TCAACTGTGT TTCCTCAAGT ATCAGAGACC ACAGCCTCAC |

TABLE 13-continued

Amino Terminal Nucleotide Sequence
(SEQ ID NO: 81)

```
4201  TCACCATTAG ACCTGGTGCA GAGACTAGCA CAGCTCTCCC AACTCAGACA
4251  ACATCCTCTC TCTTCACCCT ACTTGTAACT GGAACCAGCA GAGTTGATCT
4301  AAGTCCAACT GCTTCACCTG GTGTTTCTGC AAAAACAGCC CCACTTTCCA
4351  CCCATCCAGG GACAGAGACC AGCACAATGA TTCCAACTTC AACTCTTTCC
4401  CTTGGTTTAC TAGAGACTAC AGGCTTACTG CCACCAGCT CTTCAGCAGA
4451  GACCAGCACG AGTACTCTAA CTCTGACTGT TTCCCCTGCT GTCTCTGGGC
4501  TTTCCAGTGC CTCTATAACA ACTGATAAGC CCAAACTGT GACCTCCTGG
4551  AACACAGAAA CCTCACCATC TGTAACTTCA GTTGGACCCC CAGAATTTTC
4601  CAGGACTGTC ACAGGCACCA CTATGACCTT GATACCATCA GAGATGCCAA
4651  CACCACCTAA AACCAGTCAT GGAGAAGGAG TGAGTCCAAC CACTATCTTG
4701  AGAACTACAA TGGTTGAAGC CACTAATTTA GCTACCACAG GTTCCAGTCC
4751  CACTGTGGCC AAGACAACAA CCACCTTCAA TACACTGGCT GGAAGCCTCT
4801  TTACTCCTCT GACCACACCT GGGATGTCCA CCTTGGCCTC TGAGAGTGTG
4851  ACCTCAAGAA CAAGTTATAA CCATCGGTCC TGGATCTCCA CCACCAGCAG
4901  TTATAACCGT CGGTACTGGA CCCCTGCCAC CAGCACTCCA GTGACTTCTA
4951  CATTCTCCCC AGGGATTTCC ACATCCTCCA TCCCCAGCTC CACAGCAGCC
5001  ACAGTCCCAT TCATGGTGCC ATTCACCCTC AACTTCACCA TCACCAACCT
5051  GCAGTACGAG GAGGACATGC GGCACCCTGG TTCCAGGAAG TTCAACGCCA
5101  CAGAGAGAGA ACTGCAGGGT CTGCTCAAAC CCTTGTTCAG GAATAGCAGT
5151  CTGGAATACC TCTATTCAGG CTGCAGACTA GCCTCACTCA GGCCAGAGAA
5201  GGATAGCTCA GCCATGGCAG TGGATGCCAT CTGCACACAT CGCCCTGACC
5251  CTGAAGACCT CGGACTGGAC AGAGAGCGAC TGTACTGGGA GCTGAGCAAT
5301  CTGACAAATG GCATCCAGGA GCTGGGCCCC TACACCCTGG ACCGGAACAG
5351  TCTCTATGTC AATGGTTTCA CCCATCGAAG CTCTATGCCC ACCACCAGCA
5401  CTCCTGGGAC CTCCACAGTG GATGTGGGAA CCTCAGGGAC TCCATCCTCC
5451  AGCCCCAGCC CCACG
```

TABLE 14

Amino Terminal Protein Sequence
(SEQ ID NO: 82)

```
  1  ESVLEGTVTS AYQVPSLSTR LTRTDGIMEH ITKIPNEAAH RGTIRPVKGP
 51  QTSTSPASPK GLHTGGTKRM ETTTTALKTT TTALKTTSRA TLTTSVYTPT
101  LGTLTPLNAS RQMASTILTE MMITTPYVFP DVPETTSSLA TSLGAETSTA
151  LPRTTPSVLN RESETTASLV SRSGAERSPV IQTLDVSSSE PDTTASWVIH
201  PAETIPTVSK TTPNFFHSEL DTVSSTATSH GADVSSAIPT NISPSELDAL
251  TPLVTISGTD TSTTFPTLTK SPHETETRTT WLTHPAETSS TIPRTIPNFS
301  HHESDATPSI ATSPGAETSS AIPIMTVSPG AEDLVTSQVT SSGTDRNMTI
351  PTLTLSPGEP KTIASLVTHP EAQTSSAIPT STISPAVSRL VTSMVTSLAA
```

TABLE 14-continued

Amino Terminal Protein Sequence
(SEQ ID NO: 82)

```
 401  KTSTTNRALT NSPGEPATTV SLVTHPAQTS PTVPWTTSIF FHSKSDTTPS
 451  MTTSHGAESS SAVPTPTVST EVPGVVTPLV TSSRAVISTT IPILTLSPGE
 501  PETTPSMATS HGEEASSAIP TPTVSPGVPG VVTSLVTSSR AVTSTTIPIL
 551  TFSLGEPETT PSMATSHGTE AGSAVPTVLP EVPGMVTSLV ASSRAVTSTT
 601  LPTLTLSPGE PETTPSMATS HGAEASSTVP TVSPEVPGVV TSLVTSSSGV
 651  NSTSIPTLIL SPGELETTPS MATSHGAEAS SAVPTPTVSP GVSGVVTPLV
 701  TSSRAVTSTT IPILTLSSSE PETTPSMATS HGVEASSAVL TVSPEVPGMV
 751  TSLVTSSRAV TSTTIPTLTI SSDEPETTTS LVTHSEAKMI SAIPTLAVSP
 801  TVQGLVTSLV TSSGSETSAF SNLTVASSQP ETIDSWVAHP GTEASSVVPT
 851  LTVSTGEPFT NISLVTHPAE SSSTLPRTTS RFSHSELDTM PSTVTSPEAE
 901  SSSAISTTIS PGIPGVLTSL VTSSGRDISA TFPTVPESPH ESEATASWVT
 951  HPAVTSTTVP RTTPNYSHSE PDTTPSIATS PGAEATSDFP TITVSPDVPD
1001  MVTSQVTSSG TDTSITIPTL TLSSGEPETT TSFITYSETH TSSAIPTLPV
1051  SPGASKMLTS LVISSGTDST TTFPTLTETP YEPETTAIQL IHPAETNTMV
1101  PRTTPKFSHS KSDTTLPVAI TSPGPEASSA VSTTTISPDM SDLVTSLVPS
1151  SGTDTSTTFP TLSETPYEPE TTATWLTHPA ETSTTVSGTI PNFSHRGSDT
1201  APSMVTSPGV DTRSGVPTTT IPPSIPGVVT SQVTSSATDT STAIPTLTPS
1251  PGEPETTASS ATHPGTQTGF TVPIRTVPSS EPDTMASWVT HPPQTSTPVS
1301  RTTSSFSHSS PDATPVMATS PRTEASSAVL TTISPGAPEM VTSQITSSGA
1351  ATSTTVPTLT HSPGMPETTA LLSTHPRTET SKTFPASTVF PQVSETTASL
1401  TIRPGAETST ALPTQTTSSL FTLLVTGTSR VDLSPTASPG VSAKTAPLST
1451  HPGTETSTMI PTSTLSLGLL ETTGLLATSS SAETSTSTLT LTVSPAVSGL
1501  SSASITTDKP QTVTSWNTET SPSVTSVGPP EFSRTVTGTT MTLIPSEMPT
1551  PPKTSHGEGV SPTTILRTTM VEATNLATTG SSPTVAKTTT TFNTLAGSLF
1601  TPLTTPGMST LASESVTSRT SYNHRSWIST TSSYNRRYWT PATSTPVTST
1651  FSPGISTSSI PSSTAATVPF MVPFTLNFTI TNLQYEEDMR HPGSRKFNAT
1701  ERELQGLLKP LFRNSSLEYL YSGCRLASLR PEKDSSAMAV DAICTHRPDP
1751  EDLGLDRERL YWELSNLTNG IQELGPYTLD RNSLYVNGFT HRSSMPTTST
1801  PGTSTVDVGT SGTPSSSPSP T
```

TABLE 15

CA125 Repeat Nucleotide Sequence
(SEQ ID NO: 83 thru SEQ ID NO: 145)

(SEQ ID NO: 83)
```
  1  GCCACAGTCC CATTCATGGT GCCATTCACC CTCAACTTCA CCATCACCAA
 51  CCTGCAGTAC GAGGAGGACA TGCGGCACCC TGGTTCCAGG AAGTTCAACG
101  CCACAGAGAG AGAACTGCAG GGTCTGCTCA AACCCTTGTT CAGGAATAGC
151  AGTCTGGAAT ACCTCTATTC AGGCTGCAGA CTAGCCTCAC TCAGGCCAGA
201  GAAGGATAGC TCAGCCATGG CAGTGGATGC CATCTGCATA CATCGCCCTG
```

TABLE 15-continued

CA125 Repeat Nucleotide Sequence
(SEQ ID NO: 83 thru SEQ ID NO: 145)

```
251  ACCCTGAAGA CCTCGGACTG GACAGAGAGC GACTGTACTG GGAGCTGAGC
301  AATCTGACAA ATGGCATCCA GGAGCTGGGC CCCTACACCC TGGACCGGAA
351  CAGTCTCTAT GTCAATGGTT TCACCCATCG AAGCTCTATG CCCACCACCA
401  GCACTCCTGG GACCTCCACA GTGGATGTGG AACCTCAGG  GACTCCATCC
451  TCCAGCCCCA GCCCCACG
```

(SEQ ID NO: 84)
```
  1  GCTGCTGGCC CTCTCCTGAT GCCGTTCACC CTCAACTTCA CCATCACCAA
 51  CCTGCAGTAC GAGGAGGACA TGCGTCGCAC TGGCTCCAGG AAGTTCAACA
101  CCATGGAGAG TGTCCTGCAG GGTCTGCTCA AGCCCTTGTT CAAGAACACC
151  AGTGTTGGCC CTCTGTACTC TGGCTGCAGA TTGACCTTGC TCAGGCCCAA
201  GAAAGATGGG GCAGCCACTG GAGTGGATGC CATCTGCACC CACCGCCTTG
251  ACCCCAAAAG CCCTGGACTC AACAGGGAGC AGCTGTACTG GGAGCTAAGC
301  AAACTGACCA ATGACATTGA AGAGCTGGGC CCCTACACCC TGGACAGGAA
351  CAGTCTCTAT GTCAATGGTT TCACCCATCA GAGCTCTGTG TCCACCACCA
401  GCACTCCTGG GACCTCCACA GTGGATCTCA GAACCTCAGG GACTCCATCC
451  TCCCTCTCCA GCCCCACAAT TATG
```

(SEQ ID NO: 85)
```
  1  GCTGCTGGCC CTCTCCTGGT ACCATTCACC CTCAACTTCA CCATCACCAA
 51  CCTGCAGTAT GGGGAGGACA TGGGTCACCC TGGCTCCAGG AAGTTCAACA
101  CCACAGAGAG GGTCCTGCAG GGTCTGCTTG GTCCCATATT CAAGAACACC
151  AGTGTTGGCC CTCTGTACTC TGGCTGCAGA CTGACCTCTC TCAGGTCTGA
201  GAAGGATGGA GCAGCCACTG GAGTGGATGC CATCTGCATC CATCATCTTG
251  ACCCCAAAAG CCCTGGACTC AACAGAGAGC GGCTGTACTG GGAGCTGAGC
301  CAACTGACCA ATGGCATCAA AGAGCTGGGC CCCTACACCC TGGACAGGAA
351  CAGTCTCTAT GTCAATGGTT TCACCCATCG GACCTCTGTG CCCACCACCA
401  GCACTCCTGG GACCTCCACA GTGGACCTTG AACCTCAGG  GACTCCATTC
451  TCCCTCCCAA GCCCCGCA
```

(SEQ ID NO: 86)
```
  1  ACTGCTGGCC CTCTCCTGGT GCTGTTCACC CTCAACTTCA CCATCACCAA
 51  CCTGAAGTAT GAGGAGGACA TGCATCGCCC TGGCTCCAGG AAGTTCAACA
101  CCACTGAGAG GGTCCTGCAG ACTCTGCTTG GTCCTATGTT CAAGAACACC
151  AGTGTTGGCC TTCTGTACTC TGGCTGCAGA CTGACCTTGC TCAGGTCCGA
201  GAAGGATGGA GCAGCCACTG GAGTGGATGC CATCTGCACC CACCGTCTTG
251  ACCCCAAAAG CCCTGGACTG GACAGAGAGC AGCTATACTG GGAGCTGAGC
301  CAGCTGACCA ATGGCATCAA AGAGCTGGGC CCCTACACCC TGGACAGGAA
351  CAGTCTCTAT GTCAATGGTT TCACCCATTG GATCCCTGTG CCCACCAGCA
401  GCACTCCTGG GACCTCCACA GTGGACCTTG GGTCAGGGAC TCCATCCTCC
451  CTCCCCAGCC CCACA
```

(SEQ ID NO: 87)
```
  1  GCTGCTGGCC CTCTCCTGGT GCCATTCACC CTCAACTTCA CCATCACCAA
 51  CCTGCAGTAC GAGGAGGACA TGCATCACCC AGGCTCCAGG AAGTTCAACA
```

TABLE 15-continued

CA125 Repeat Nucleotide Sequence
(SEQ ID NO: 83 thru SEQ ID NO: 145)

```
101  CCACGGAGCG GGTCCTGCAG GGTCTGCTTG GTCCCATGTT CAAGAACACC
151  AGTGTCGGCC TTCTGTACTC TGGCTGCAGA CTGACCTTGC TCAGGTCCGA
201  GAAGGATGGA GCAGCCACTG GAGTGGATGC CATCTGCACC CACCGTCTTG
251  ACCCCAAAAG CCCTGGAGTG GACAGGGAGC AGCTATACTG GGAGCTGAGC
301  CAGCTGACCA ATGGCATCAA AGAGCTGGGT CCCTACACCC TGGACAGAAA
351  CAGTCTCTAT GTCAATGGTT TCACCCATCA GACCTCTGCG CCCAACACCA
401  GCACTCCTGG GACCTCCACA GTGGACCTTG GACCTCAGG GACTCCATCC
451  TCCCTCCCCA GCCCTACA
```

(SEQ ID NO: 88)
```
  1  NCNNCTGNCC CTCTCCTGNT NCCNTTCACC NTCAACTTNA CCATCACCAA
 51  CCTGCANTAN GNGGANNACA TGCNNCNCCC NGGNTCCAGG AAGTTCAACA
101  CCACNGAGNG NGTNCTGCAG GGTCTGCTNN NNCCCNTNTT CAAGAACACC
151  AGTGTTGGCC CTCTGTACTC TGGCTGCAGA CTGACCTTGC TCAGGTCCGA
201  GAAGGATGGA GCAGCCACTG GAGTGGATGC CATCTGCACC CACCGTCTTG
251  ACCCCAAAAG CCCTGGAGTG GACAGGGAGC AGCTATACTG GGAGCTGAGC
301  CAGCTGACCA ATGGCATCAA AGAGCTGGGT CCCTACACCC TGGACAGAAA
351  CAGTCTCTAT GTCAATGGTT TCACCCATCA GACCTCTGCG CCCAACACCA
401  GCACTCCTGG GACCTCCACA GTGGACCTTG GACCTCAGG GACTCCATCC
451  TCCCTCCCCA GCCCTACA
```

(SEQ ID NO: 89)
```
  1  TCTGCTGGCC CTCTCCTGGT GCCATTCACC CTCAACTTCA CCATCACCAA
 51  CCTGCAGTAC GAGGAGGACA TGCATCACCC AGGCTCCAGG AAGTTCAACA
101  CCACGGAGCG GGTCCTGCAG GGTCTGCTTG GTCCCATGTT CAAGAACACC
151  AGTGTCGGCC TTCTGTACTC TGGCTGCAGA CTGACCTTGC TCAGGCCTGA
201  GAAGAATGGG GCAGCCACTG GAATGGATGC CATCTGCAGC CACCGTCTTG
251  ACCCCAAAAG CCCTGGACTC AACAGAGAGC AGCTGTACTG GGAGCTGAGC
301  CAGCTGACCC ATGGCATCAA AGAGCTGGGC CCCTACACCC TGGACAGGAA
351  CAGTCTCTAT GTCAATGGTT TCACCCATCG GAGCTCTGTG GCCCCCACCA
401  GCACTCCTGG GACCTCCACA GTGGACCTTG GACCTCAGG GACTCCATCC
451  TCCCTCCCCA GCCCCACA
```

(SEQ ID NO: 90)
```
  1  ACAGCTGTTC CTCTCCTGGT GCCGTTCACC CTCAACTTTA CCATCACCAA
 51  TCTGCAGTAT GGGGAGGACA TGCGTCACCC TGGCTCCAGG AAGTTCAACA
101  CCACAGAGAG GGTCCTGCAG GGTCTGCTTG GTCCCTTGTT CAAGAACTCC
151  AGTGTCGGCC CTCTGTACTC TGGCTGCAGA CTGATCTCTC TCAGGTCTGA
201  GAAGGATGGG GCAGCCACTG GAGTGGATGC CATCTGCACC CACCACCTTA
251  ACCCTCAAAG CCCTGGACTG GACAGGGAGC AGCTGTACTG GCAGCTGAGC
301  CAGATGACCA ATGGCATCAA AGAGCTGGGC CCCTACACCC TGGACGGAA
351  CAGTCTCTAC GTCAATGGTT TCACCCATCG GAGCTCTGGG CTCACCACCA
```

TABLE 15-continued

CA125 Repeat Nucleotide Sequence
(SEQ ID NO: 83 thru SEQ ID NO: 145)

```
401  GCACTCCTTG GACTTCCACA GTTGACCTTG AACCTCAGG GACTCCATCC

451  CCCGTCCCCA GCCCCACA
```

(SEQ ID NO: 91)
```
  1  ACTGCTGGCC CTCTCCTGGT GCCATTCACC CTCAACTTCA CCATCACCAA

51  CCTGCAGTAT GAGGAGGACA TGCATCGCCC TGGATCTAGG AAGTTCAACA

101  CCACAGAGAG GGTCCTGCAG GGTCTGCTTA GTCCCATTTT CAAGAACTCC

151  AGTGTTGGCC CTCTGTACTC TGGCTGCAGA CTGACCTCTC TCAGGCCCGA

201  GAAGGATGGG GCAGCAACTG GAATGGATGC TGTCTGCCTC TACCACCCTA

251  ATCCCAAAAG ACCTGGACTG GACAGAGAGC AGCTGTACTG GGAGCTAAGC

301  CAGCTGACCC ACAACATCAC TGAGCTGGGC CCCTACAGCC TGGACAGGGA

351  CAGTCTCTAT GTCAATGGTT TCACCCATCA GAACTCTGTG CCCACCACCA

401  GTACTCCTGG GACCTCCACA GTGTACTGGG CAACCACTGG GACTCCATCC

451  TCCTTCCCCG GCCACACA
```

(SEQ ID NO: 92)
```
  1  GAGCCTGGCC CTCTCCTGAT ACCATTCACT TTCAACTTTA CCATCACCAA

51  CCTGCATTAT GAGGAAAACA TGCAACACCC TGGTTCCAGG AAGTTCAACA

101  CCACGGAGAG GGTTCTGCAG GGTCTGCTCA AGCCCTTGTT CAAGAACACC

151  AGTGTTGGCC CTCTGTACTC TGGCTGCAGA CTGACCTCTC TCAGGCCCGA

201  GAAGGATGGG GCAGCAACTG GAATGGATGC TGTCTGCCTC TACCACCCTA

251  ATCCCAAAAG ACCTGGGCTG GACAGAGAGC AGCTGTACTG GGAGCTAAGC

301  CAGCTGACCC ACAACATCAC TGAGCTGGGC CCCTACAGCC TGGACAGGGA

351  CAGTCTCTAT GTCAATGGTT TCACCCATCA GAACTCTGTG CCCACCACCA

401  GTACTCCTGG GACCTCCACA GTGTACTGGG CAACCACTGG GACTCCATCC

451  TCCTTCCCCG GCCACACA
```

(SEQ ID NO: 93)
```
  1  GAGCCTGGCC CTCTCCTGAT ACCATTCACT TTCAACTTTA CCATCACCAA

51  CCTGCATTAT GAGGAAAACA TGCAACACCC TGGTTCCAGG AAGTTCAACA

101  CCACGGAGAG GGTTCTGCAG GGTCTGCTCA AGCCCTTGTT CAAGAACACC

151  AGTGTTGGCC CTCTGTACTC TGGCTGCAGA CTGACCTTGC TCAGACCTGA

201  GAAGCATGAG GCAGCCACTG GAGTGGACAC CATCTGTACC CACCGCGTTG

251  ATCCCATCGG ACCTGGACTG GACAGGGAGC GGCTATACTG GGAGCTGAGC

301  CAGCTGACCA ACAGCATTAC CGAACTGGGA CCCTACACCC TGGACAGGGA

351  CAGTCTCTAT GTCAATGGCT TCAACCCTCG GAGCTCTGTG CCAACCACCA

401  GCACTCCTGG GACCTCCACA GTGCACCTGG CAACCTCTGG GACTCCATCC

451  TCCCTGCCTG GCCACACA
```

(SEQ ID NO: 94)
```
  1  GCCCCTGTCC CTCTCTTGAT ACCATTCACC CTCAACTTTA CCATCACCAA

51  CCTGCATTAT GAGGAAAACA TGCAACACCC TGGTTCCAGG AAGTTCAACA

101  CCACGGAGAG GGTTCTGCAG GGTCTGCTCA AGCCCTTGTT CAAGAACACC

151  AGTGTTGGCC CTCTGTACTC TGGCTGCAGA CTGACCTTGC TCAGACCTGA

201  GAAGCATGAG GCAGCCACTG GAGTGGACAC CATCTGTACC CACCGCGTTG
```

TABLE 15-continued

CA125 Repeat Nucleotide Sequence
(SEQ ID NO: 83 thru SEQ ID NO: 145)

```
251  ATCCCATCGG ACCTGGACTG NACAGNGAGC NGCTNTACTG GGAGCTNAGC

301  CANCTGACCA ANNNCATCNN NGAGCTGGGN CCCTACACCC TGGACAGGNA

351  CAGTCTCTAT GTCAATGGTT TCACCCATCN GANCTCTGNG CCCACCACCA

401  GCACTCCTGG GACCTCCACA GTGNACNTNG GNACCTCNGG GACTCCATCC

451  TCCNTCCCCN GCCNCACA
```

(SEQ ID NO: 95)
```
  1  TCTGCTGGCC CTCTCCTGGT GCCATTCACC CTCAACTTCA CCATCACCAA

51  CCTGCAGTAC GAGGAGGACA TGCATCACCC AGGCTCCAGG AAGTTCAACA

101  CCACGGAGCG GGTCCTGCAG GGTCTGCTTG GTCCCATGTT CAAGAACACC

151  AGTGTCGGCC TTCTGTACTC TGGCTGCAGA CTGACCTTGC TCAGGCCTGA

201  GAAGAATGGG GCAGCCACTG GAATGGATGC CATCTGCAGC CACCGTCTTG

251  ACCCCAAAAG CCCTGGACTC GACAGAGAGC AGCTGTACTG GGAGCTGAGC

301  CAGCTGACCC ATGGCATCAA AGAGCTGGGC CCCTACACCC TGGACAGGAA

351  CAGTCTCTAT GTCAATGGTT TCACCCATCG GAGCTCTGTG GCCCCCACCA

401  GCACTCCTGG GACCTCCACA GTGGACCTTG GACCTCAGG GACTCCATCC

451  TCCCTCCCCA GCCCCACA
```

(SEQ ID NO: 96)
```
  1  ACAGCTGTTC CTCTCCTGGT GCCGTTCACC CTCAACTTTA CCATCACCAA

51  TCTGCAGTAT GGGGAGGACA TGCGTCACCC TGGCTCCAGG AAGTTCAACA

101  CCACAGAGAG GGTCCTGCAG GGTCTGCTTG GTCCCTTGTT CAAGAACTCC

151  AGTGTCGGCC CTCTGTACTC TGGCTGCAGA CTGATCTCTC TCAGGTCTGA

201  GAAGGATGGG GCAGCCACTG GAGTGGATGC CATCTGCACC CACCACCTTA

251  ACCCTCAAAG CCCTGGACTG GACAGGGAGC AGCTGTACTG GCAGCTGAGC

301  CAGATGACCA ATGGCATCAA AGAGCTGGGC CCCTACACCC TGGACCGGAA

351  CAGTCTCTAC GTCAATGGTT TCACCCATCG GAGCTCTGGG CTCACCACCA

401  GCACTCCTTG GACTTCCACA GTTGACCTTG GAACCTCAGG GACTCCATCC

451  CCCGTCCCCA GCCCCACA
```

(SEQ ID NO: 97)
```
  1  ACTGCTGGCC CTCTCCTGGT GCCATTCACC CTAAACTTCA CCATCACCAA

51  CCTGCAGTAT GAGGAGGACA TGCATCGCCC TGGATCTAGG AAGTTCAACG

101  CCACAGAGAG GGTCCTGCAG GGTCTGCTTA GTCCCATATT CAAGAACTCC

151  AGTGTTGGCC CTCTGTACTC TGGCTGCAGA CTGACCTCTC TCAGGCCCGA

201  GAAGGATGGG GCAGCAACTG GAATGGATGC TGTCTGCCTC TACCACCCTA

251  ATCCCAAAAG ACCTGGACTG GACAGAGAGC AGCTGTACTG GGAGCTAAGC

301  CAGCTGACCC ACAACATCAC TGAGCTGGGC CCCTACAGCC TGGACAGGGA

351  CAGTCTCTAT GTCAATGGTT TCACCCATCA GAGCTCTATG ACGACCACCA

401  GAACTCCTGA TACCTCCACA ATGCACCTGG CAACCTCGAG AACTCCAGCC

451  TCCCTGTCTG GACCTACG
```

TABLE 15-continued

CA125 Repeat Nucleotide Sequence
(SEQ ID NO: 83 thru SEQ ID NO: 145)

(SEQ ID NO: 98)
```
  1 ACCGCCAGCC CTCTCCTGGT GCTATTCACA ATCAACTGCA CCATCACCAA
 51 CCTGCAGTAC GAGGAGGACA TGCGTCGCAC TGGCTCCAGG AAGTTCAACA
101 CCATGGAGAG TGTCCTGCAG GGTCTGCTCA AGCCCTTGTT CAAGAACACC
151 AGTGTTGGCC CTCTGTACTC TGGCTGCAGA TTGACCTTGC TCAGGCCCAA
201 GAAAGATGGG GCAGCCACTG GAGTGGATGC CATCTGCACC CACCGCCTTG
251 ACCCCAAAAG CCCTGGACTC AACAGGGAGC AGCTGTACTG GGAGCTAAGC
301 AAACTGACCA ATGACATTGA AGAGCTGGGC CCCTACACCC TGGACAGGAA
351 CAGTCTCTAT GTCAATGGTT TCACCCATCA GAGCTCTGTG TCCACCACCA
401 GCACTCCTGG GACCTCCACA GTGGATCTCA GAACCTCAGG GACTCCATCC
451 TCCCTCTCCA GCCCCACAAT TATG
```

(SEQ ID NO: 99)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGAG GGTCCTACAG GGTCTGCTCA GGCCCTTGTT CAAGAACACC
151 AGTGTCAGCT CTCTGTACTC TGGTTGCAGA CTGACCTTGC TCAGGCCTGA
201 GAAGGATGGG GCAGCCACCA GAGTGGATGC TGCCTGCACC TACCGCCCTG
251 ATCCCAAAAG CCCTGGACTG GACAGAGAGC AACTATACTG GGAGCTGAGC
301 CAGCTAACCC ACAGCATCAC TGAGCTGGGA CCCTACACCC TGGACAGGGT
351 CAGTCTCTAT GTCAATGGCT TCAACCCTCG GAGCTCTGTG CCAACCACCA
401 GCACTCCTGG GACCTCCACA GTGCACCTGG CAACCTCTGG GACTCCATCC
451 TCCCTGCCTG GCCACACA
```

(SEQ ID NO: 100)
```
  1 GCCCCTGTCC CTCTCTTGAT ACCATTCACC CTCAACTTTA CCATCACCAA
 51 CCTGCATTAT GAAGAAAACA TGCAACACCC TGGTTCCAGG AAGTTCAACA
101 CCACGGAGAG GGTTCTGCAG GGTCTGCTCA AGCCCTTGTT CAAGAGCACC
151 AGCGTTGGCC CTCTGTACTC TGGCTGCAGA CTGACCTTGC TCAGACCTGA
201 GAAACATGGG GCAGCCACTG GAGTGGACGC CATCTGCACC CTCCGCCTTG
251 ATCCCACTGG TCCTGGACTG GACAGAGAGC GGCTATACTG GGAGCTGAGC
301 CAGCTGACCA ACAGCGTTAC AGAGCTGGGC CCCTACACCC TGGACAGGGA
351 CAGTCTCTAT GTCAATGGCT TCACCCAGCG GAGCTCTGTG CCAACCACCA
401 GTATTCCTGG GACCTCTGCA GTGCACCTGG AAACCTCTGG GACTCCAGCC
451 TCCCTCCCTG GCCACACA
```

(SEQ ID NO: 101)
```
  1 GCCCCTGGCC CTCTCCTGGT GCCATTCACC CTCAACTTCA CTATCACCAA
 51 CCTGCAGTAT GAGGTGGACA TGCGTCACCC TGGTTCCAGG AAGTTCAACA
101 CCACGGAGAG AGTCCTGCAG GGTCTGCTCA AGCCCTTGTT CAAGAGCACC
151 AGTGTTGGCC CTCTGTACTC TGGCTGCAGA CTGACCTTGC TCAGGCCTGA
201 AAAACGTGGG GCAGCCACCG GCGTGGACAC CATCTGCACT CACCGCCTTG
251 ACCCTCTAAA CCCTGGACTG GACAGAGAGC AGCTATACTG GGAGCTGAGC
301 AAACTGACCC GTGGCATCAT CGAGCTGGGC CCCTACCTCC TGGACAGAGG
```

TABLE 15-continued

CA125 Repeat Nucleotide Sequence
(SEQ ID NO: 83 thru SEQ ID NO: 145)

```
351  CAGTCTCTAT GTCAATGGTT TCACCCATCG GAACTTTGTG CCCATCACCA
401  GCACTCCTGG GACCTCCACA GTACACCTAG GAACCTCTGA AACTCCATCC
451  TCCCTACCTA GACCCATA
```

(SEQ ID NO: 102)
```
  1  GTGCCTGGCC CTCTCCTGGT GCCATTCACC CTCAACTTCA CCATCACCAA
 51  CTTGCAGTAT GAGGAGGCCA TGCGACACCC TGGCTCCAGG AAGTTCAATA
101  CCACGGAGAG GGTCCTACAG GGTCTGCTCA GGCCCTTGTT CAAGAATACC
151  AGTATCGGCC CTCTGTACTC CAGCTGCAGA CTGACCTTGC TCAGGCCAGA
201  GAAGGACAAG GCAGCCACCA GAGTGGATGC CATCTGTACC CACCACCCTG
251  ACCCTCAAAG CCCTGGACTG AACAGAGAGC AGCTGTACTG GGAGCTGAGC
301  CAGCTGACCC ACGGCATCAC TGAGCTGGGC CCCTACACCC TGGACAGGGA
351  CAGTCTCTAT GTCGATGGTT TCACTCATTG GAGCCCCATA CCGACCACCA
401  GCACTCCTGG GACCTCCATA GTGAACCTGG GAACCTCTGG GATCCCACCT
451  TCCCTCCCTG AAACTACA
```

(SEQ ID NO: 103)
```
  1  NCNNCTGNCC CTCTCCTGNT NCCNTTCACC NTCAACTTNA CCATCACCAA
 51  CCTGCANTAN GNGGANNACA TGCNNCNCCC NGGNTCCAGG AAGTTCAACA
101  CCACNGAGAG GGTTCTGCAG GGTCTGCTCA AACCCTTGTT CAGGAATAGC
151  AGTCTGGAAT ACCTCTATTC AGGCTGCAGA CTAGCCTCAC TCAGGCCAGA
201  GAAGGATAGC TCAGCCATGG CAGTGGATGC CATCTGCACA CATCGCCCTG
251  ACCCTGAAGA CCTCGGACTG GACAGAGAGC GACTGTACTG GGAGCTGAGC
301  AATCTGACAA ATGGCATCCA GGAGCTGGGC CCCTACACCC TGGACCGGAA
351  CAGTCTCTAC GTCAATGGTT TCACCCATCG GAGCTCTGGG CTCACCACCA
401  GCACTCCTTG GACTTCCACA GTTGACCTTG GAACCTCAGG GACTCCATCC
451  CCCGTCCCCA GCCCCACA
```

(SEQ ID NO: 104)
```
  1  ACTGCTGGCC CTCTCCTGGT GCCATTCACC CTCAACTTCA CCATCACCAA
 51  CCTGCAGTAT GAGGAGGACA TGCATCGCCC TGGTTCCAGG AGGTTCAACA
101  CCACGGAGAG GGTTCTGCAG GGTCTGCTCA CGCCCTTGTT CAAGAACACC
151  AGTGTTGGCC CTCTGTACTC TGGCTGCAGA CTGACCTTGC TCAGACCTGA
201  GAAGCAAGAG GCAGCCACTG GAGTGGACAC CATCTGTACC CACCGCGTTG
251  ATCCCATCGG ACCTGGACTG GACAGAGAGC GGCTATACTG GGAGCTGAGC
301  CAGCTGACCA ACAGCATCAC AGAGCTGGGA CCCTACACCC TGGATAGGGA
351  CAGTCTCTAT GTCAATGGCT TCAACCCTTG GAGCTCTGTG CCAACCACCA
401  GCACTCCTGG GACCTCCACA GTGCACCTGG CAACCTCTGG GACTCCATCC
451  TCCCTGCCTG GCCACACA
```

(SEQ ID NO: 105)
```
  1  GCCCCTGTCC CTCTCTTGAT ACCATTCACC CTCAACTTTA CCATCACCGA
 51  CCTGCATTAT GAAGAAAACA TGCAACACCC TGGTTCCAGG AAGTTCAACA
101  CCACGGAGAG GGTTCTGCAG GGTCTGCTCA AGCCCTTGTT CAAGAGCACC
```

TABLE 15-continued

CA125 Repeat Nucleotide Sequence
(SEQ ID NO: 83 thru SEQ ID NO: 145)

```
151 AGCGTTGGCC CTCTGTACTC TGGCTGCAGA CTGACCTTGC TCAGACCTGA
201 GAAACATGGG GCAGCCACTG GAGTGGACGC CATCTGCACC CTCCGCCTTG
251 ATCCCACTGG TCCTGGACTG GACAGAGAGC GGCTATACTG GGAGCTGAGC
301 CAGCTGACCA ACAGCGTTAC AGAGCTGGGC CCCTACACCC TGGACAGGGA
351 CAGTCTCTAT GTCAATGGCT TCACCCATCG GAGCTCTGTG CCAACCACCA
401 GTATTCCTGG GACCTCTGCA GTGCACCTGG AAACCTCTGG GACTCCAGCC
451 TCCCTCCCTG GCCACACA
```

(SEQ ID NO: 106)
```
  1 GCCCCTGGCC CTCTCCTGGT GCCATTCACC CTCAACTTCA CTATCACCAA
 51 CCTGCAGTAT GAGGAGGACA TGCGTCACCC TGGTTCCAGG AAGTTCAGCA
101 CCACGGAGAG AGTCCTGCAG GGTCTGCTCA AGCCCTTGTT CAAGAACACC
151 AGTGTCAGCT CTCTGTACTC TGGTTGCAGA CTGACCTTGC TCAGGCCTGA
201 GAAGGATGGG GCAGCCACCA GAGTGGATGC TGTCTGCACC CATCGTCCTG
251 ACCCCAAAAG CCCTGGACTG GACAGAGAGC GGCTGTACTG GAAGCTGAGC
301 CAGCTGACCC ACGGCATCAC TGAGCTGGGC CCCTACACCC TGGACAGGCA
351 CAGTCTCTAT GTCAATGGTT TCACCCATCA GAGCTCTATG ACGACCACCA
401 GAACTCCTGA TACCTCCACA ATGCACCTGG CAACCTCGAG AACTCCAGCC
451 TCCCTGTCTG GACCTACG
```

(SEQ ID NO: 107)
```
  1 ACCGCCAGCC CTCTCCTGGT GCTATTCACA ATTAACTTCA CCATCACTAA
 51 CCTGCGGTAT GAGGAGAACA TGCATCACCC TGGCTCTAGA AAGTTTAACA
101 CCACGGAGAG AGTCCTTCAG GGTCTGCTCA GGCCTGTGTT CAAGAACACC
151 AGTGTTGGCC CTCTGTACTC TGGCTGCAGA CTGACCACGC TCAGGCCCAA
201 GAAGGATGGG GCAGCCACCA AAGTGGATGC CATCTGCACC TACCGCCCTG
251 ATCCCAAAAG CCCTGGACTG GACAGAGAGC AGCTATACTG GGAGCTGAGC
301 CAGCTAACCC ACAGCATCAC TGAGCTGGGC CCCTACACCC AGGACAGGGA
351 CAGTCTCTAT GTCAATGGCT TCACCCATCG GAGCTCTGTG CCAACCACCA
401 GTATTCCTGG GACCTCTGCA GTGCACCTGG AAACCTCTGG GACTCCAGCC
451 TCCCTCCCTG GCCACACA
```

(SEQ ID NO: 108)
```
  1 GCCCCTGGCC CTCTCCTGGT GCCATTCACC CTCAACTTCA CTATCACCAA
 51 CCTGCAGTAT GAGGAGGACA TGCGTCACCC TGGTTCCAGG AAGTTCAACA
101 CCACGGAGAG AGTCCTGCAG GGTCTGCTCA AGCCCTTGTT CAAGAGCACC
151 AGTGTTGGCC CTCTGTACTC TGGCTGCAGA CTGACCTTGC TCAGGCCTGA
201 AAAACGTGGG GCAGCCACCG GCGTGGACAC CATCTGCACT CACCGCCTTG
251 ACCCTCTAAA CCCAGGACTG GACAGAGAGC AGCTATACTG GGAGCTGAGC
301 AAACTGACCC GTGGCATCAT CGAGCTGGGC CCCTACCTCC TGGACAGAGG
351 CAGTCTCTAT GTCAATGGTT TCACCCATCG GACCTCTGTG CCCACCACCA
401 GCACTCCTGG GACCTCCACA GTGGACCTTG GAACCTCAGG GACTCCATTC
451 TCCCTCCCAA GCCCCGCA
```

TABLE 15-continued

CA125 Repeat Nucleotide Sequence
(SEQ ID NO: 83 thru SEQ ID NO: 145)

(SEQ ID NO: 109)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGAG GGTCCTGCAG ACTCTGCTTG GTCCTATGTT CAAGAACACC
151 AGTGTTGGCC TTCTGTACTC TGGCTGCAGA CTGACCTTGC TCAGGTCCGA
201 GAAGGATGGA GCAGCCACTG GAGTGGATGC CATCTGCACC CACCGTCTTG
251 ACCCCAAAAG CCCTGGAGTG GACAGGGAGC AACTATACTG GGAGCTGAGC
301 CAGCTGACCA ATGGCATTAA AGAACTGGGC CCCTACACCC TGGACAGGAA
351 CAGTCTCTAT GTCAATGGGT TCACCCATTG GATCCCTGTG CCCACCAGCA
401 GCACTCCTGG GACCTCCACA GTGGACCTTG GGTCAGGGAC TCCATCCTCC
451 CTCCCCAGCC CCACA
```

(SEQ ID NO: 110)
```
  1 ACTGCTGGCC CTCTCCTGGT GCCGTTCACC CTCAACTTCA CCATCACCAA
 51 CCTGAAGTAC GAGGAGGACA TGCATTGCCC TGGCTCCAGG AAGTTCAACA
101 CCACAGAGAG AGTCCTGCAG AGTCTGCTTG GTCCCATGTT CAAGAACACC
151 AGTGTTGGCC CTCTGTACTC TGGCTGCAGA CTGACCTTGC TCAGGTCCGA
201 GAAGGATGGA GCAGCCACTG GAGTGGATGC CATCTGCACC CACCGTCTTG
251 ACCCCAAAAG CCCTGGAGTG GACAGGGAGC AGCTATACTG GGAGCTGAGC
301 CAGCTGACCA ATGGCATCAA AGAGCTGGGT CCCTACACCC TGGACAGAAA
351 CAGTCTCTAT GTCAATGGTT TCACCCATCA GACCTCTGCG CCCAACACCA
401 GCACTCCTGG GACCTCCACA GTGGACCTTG GGACCTCAGG GACTCCATCC
451 TCCCTCCCCA GCCCTACA
```

(SEQ ID NO: 111)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGNG NGTNCTGCAG GGTCTGCTNN NNCCCNTNTT CAAGAACNCC
151 AGTGTNGGCC NTCTGTACTC TGGCTGCAGA CTGACCTNNC TCAGGNCNGA
201 GAAGNATGGN GCAGCCACTG GANTGGATGC CATCTGCANC CACCNNCNTN
251 ANCCCAAAAG NCCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATTG GATCCCTGTG CCCACCAGCA
401 GCACTCCTGG GACCTCCACA GTGGACCTTG GGTCAGGGAC TCCATCCTCC
451 CTCCCCAGCC CCACA
```

(SEQ ID NO: 112)
```
  1 ACTGCTGGCC CTCTCCTGGT GCCGTTCACC CTCAACTTCA CCATCACCAA
 51 CCTGAAGTAC GAGGAGGACA TGCATTGCCC TGGCTCCAGG AAGTTCAACA
101 CCACAGAGAG AGTCCTGCAG AGTCTGCTTG GTCCCATGTT CAAGAACACC
151 AGTGTTGGCC CTCTGTACTC TGGCTGCAGA CTGACCTCGC TCAGGTCCGA
201 GAAGGATGGA GCAGCCACTG GAGTGGATGC CATCTGCACC CACCGTGTTG
251 ACCCCAAAAG CCCTGGAGTG GACAGGGAGC AGCTATACTG GGAGCTGAGC
301 CAGCTGACCA ATGGCATCAA AGAGCTGGGT CCCTACACCC TGGACAGAAA
```

TABLE 15-continued

CA125 Repeat Nucleotide Sequence
(SEQ ID NO: 83 thru SEQ ID NO: 145)

```
351  CAGTCTCTAT GTCAATGGTT TCACCCATCA GACCTCTGCG CCCAACACCA
401  GCACTCCTGG GACCTCCACA GTGNACNTNG GNACCTCNGG GACTCCATCC
451  TCCNTCCCCN GCCNCACA
```

(SEQ ID NO: 113)
```
  1  TCTGCTGGCC CTCTCCTGGT GCCATTCACC CTCAACTTCA CCATCACCAA
 51  CCTGCAGTAC GAGGAGGACA TGCATCACCC AGGCTCCAGG AAGTTCAACA
101  CCACGGAGCG GGTCCTGCAG GGTCTGCTTG GTCCCATGTT CAAGAACACC
151  AGTGTCGGCC TTCTGTACTC TGGCTGCAGA CTGACCTTGC TCAGGCCTGA
201  GAAGAATGGG GCAACCACTG GAATGGATGC CATCTGCACC CACCGTCTTG
251  ACCCCAAAAG CCCTGGACTG NACAGNGAGC NGCTNTACTG GGAGCTNAGC
301  CANCTGACCA ANNNCATCNN NGAGCTGGGN CCCTACACCC TGGACAGGNA
351  CAGTCTCTAT GTCAATGGTT TCACCCATCN GANCTCTGNG CCCACCACCA
401  GCACTCCTGG GACCTCCACA GTGNACNTNG GNACCTCNGG GACTCCATCC
451  TCCNTCCCCN GCCNCACA
```

(SEQ ID NO: 114)
```
  1  NCNNCTGNCC CTCTCCTGNT NCCNTTCACC NTCAACTTNA CCATCACCAA
 51  CCTGCANTAN GNGGANNACA TGCNNCNCCC NGGNTCCAGG AAGTTCAACA
101  CCACNGAGAG GGTTCTGCAG GGTCTGCTCA AACCCTTGTT CAGGAATAGC
151  AGTCTGGAAT ACCTCTATTC AGGCTGCAGA CTAGCCTCAC TCAGGCCAGA
201  GAAGGATAGC TCAGCCATGG CAGTGGATGC CATCTGCACA CATCGCCCTG
251  ACCCTGAAGA CCTCGGACTG GACAGAGAGC GACTGTACTG GGAGCTGAGC
301  AATCTGACAA ATGGCATCCA GGAGCTGGGC CCCTACACCC TGGACCGGAA
351  CAGTCTCTAT GTCAATGGTT TCACCCATCG AAGCTCTATG CCCACCACCA
401  GCACTCCTGG GACCTCCACA GTGGATGTGG GAACCTCAGG GACTCCATCC
451  TCCAGCCCCA GCCCCACG
```

(SEQ ID NO: 115)
```
  1  ACTGCTGGCC CTCTCCTGAT ACCATTCACC CTCAACTTCA CCATCACCAA
 51  CCTGCAGTAT GGGGAGGACA TGGGTCACCC TGGCTCCAGG AAGTTCAACA
101  CCACAGAGAG GGTCCTGCAG GGTCTGCTTG GTCCCATATT CAAGAACACC
151  AGTGTTGGCC CTCTGTACTC TGGCTGCAGA CTGACCTCTC TCAGGTCTGA
201  GAAGGATGGA GCAGCCACTG GAGTGGATGC CATCTGCATC CATCATCTTG
251  ACCCCAAAAG CCCTGGACTC AACAGAGAGC GGCTGTACTG GGAGCTGAGC
301  CAACTGACCA ATGGCATCAA AGAGCTGGGC CCCTACACCC TGGACAGGAA
351  CAGTCTCTAT GTCAATGGTT TCACCCATCG GACCTCTGTG CCCACCACCA
401  GCACTCCTGG GACCTCCACA GTGGACCTTG GAACCTCAGG GACTCCATTC
451  TCCCTCCCAA GCCCCGCA
```

(SEQ ID NO: 116)
```
  1  ACTGCTGGCC CTCTCCTGGT GCTGTTCACC CTCAACTTCA CCATCACCAA
 51  CCTGAAGTAT GAGGAGGACA TGCATCGCCC TGGCTCCAGG AAGTTCAACA
101  CCACTGAGAG GGTCCTGCAG ACTCTGCTTG GTCCTATGTT CAAGAACACC
```

TABLE 15-continued

CA125 Repeat Nucleotide Sequence
(SEQ ID NO: 83 thru SEQ ID NO: 145)

```
151  AGTGTTGGCC TTCTGTACTC TGGCTGCAGA CTGACCTTGC TCAGGTCCGA
201  GAAGGATGGA GCAGCCACTG GAGTGGATGC CATCTGCACC CACCGTCTTG
251  ACCCCAAAAG CCCTGGACTG NACAGNGAGC NGCTNTACTG GGAGCTNAGC
301  CANCTGACCA ANNNCATCNN NGAGCTGGGN CCCTACACCC TGGACAGGNA
351  CAGTCTCTAT GTCAATGGTT TCACCCATCN GANCTCTGNG CCCACCACCA
401  GCACTCCTGG GACCTCCACA GTGNACNTNG GNACCTCNGG GACTCCATCC
451  TCCNTCCCCN GCCNCACA
```

(SEQ ID NO: 117)
```
  1  NCNNCTGNCC CTCTCCTGNT NCCNTTCACC NTCAACTTNA CCATCACCAA
 51  CCTGCANTAN GNGGANNACA TGCNNCNCCC NGGNTCCAGG AAGTTCAACA
101  CCACNGAGAG AGTCCTTCAG GGTCTGCTCA GGCCTGTGTT CAAGAACACC
151  AGTGTTGGCC CTCTGTACTC TGGCTGCAGA CTGACCTTGC TCAGGCCCAA
201  GAAGGATGGG GCAGCCACCA AAGTGGATGC CATCTGCACC TACCGCCCTG
251  ATCCCAAAAG CCCTGGACTG GACAGAGAGC AGCTATACTG GGAGCTGAGC
301  CAGCTAACCC ACAGCATCAC TGAGCTGGGC CCCTACACCC AGGACAGGGA
351  CAGTCTCTAT GTCAATGGCT TCACCCATCG GAGCTCTGTG CCAACCACCA
401  GTATTCCTGG GACCTCTGCA GTGCACCTGG AAACCACTGG GACTCCATCC
451  TCCTTCCCCG GCCACACA
```

(SEQ ID NO: 118)
```
  1  GAGCCTGGCC CTCTCCTGAT ACCATTCACT TTCAACTTTA CCATCACCAA
 51  CCTGCGTTAT GAGGAAAACA TGCAACACCC TGGTTCCAGG AAGTTCAACA
101  CCACGGAGAG GGTTCTGCAG GGTCTGCTCA CGCCCTTGTT CAAGAACACC
151  AGTGTTGGCC CTCTGTACTC TGGCTGCAGA CTGACCTTGC TCAGACCTGA
201  GAAGCAGGAG GCAGCCACTG GAGTGGACAC CATCTGTACC CACCGCGTTG
251  ATCCCATCGG ACCTGGACTG GACAGAGAGC GGCTATACTG GGAGCTGAGC
301  CAGCTGACCA ACAGCATCAC AGAGCTGGGA CCCTACACCC TGGATAGGGA
351  CAGTCTCTAT GTCGATGGCT TCAACCCTTG GAGCTCTGTG CCAACCACCA
401  GCACTCCTGG GACCTCCACA GTGCACCTGG CAACCTCTGG GACTCCATCC
451  CCCCTGCCTG GCCACACA
```

(SEQ ID NO: 119)
```
  1  GCCCCTGTCC CTCTCTTGAT ACCATTCACC CTCAACTTTA CCATCACCGA
 51  CCTGCATTAT GAAGAAAACA TGCAACACCC TGGTTCCAGG AAGTTCAACA
101  CCACGGAGAG GGTTCTGCAG GGTCTGCTCA AGCCCTTGTT CAAGAGCACC
151  AGCGTTGGCC CTCTGTACTC TGGCTGCAGA CTGACCTTGC TCAGACCTGA
201  GAAACATGGG GCAGCCACTG GAGTGGACGC CATCTGCACC CTCCGCCTTG
251  ATCCCACTGG TCCTGGACTG GACAGAGAGC GGCTATACTG GGAGCTGAGC
301  CAGCTGACCA ACAGCATCAC AGAGCTGGGA CCCTACACCC TGGATAGGGA
351  CAGTCTCTAT GTCAATGGCT TCAACCCTTG GAGCTCTGTG CCAACCACCA
401  GCACTCCTGG GACCTCCACA GTGCACCTGG CAACCTCTGG GACTCCATCC
451  TCCCTGCCTG GCCACACA
```

TABLE 15-continued

CA125 Repeat Nucleotide Sequence
(SEQ ID NO: 83 thru SEQ ID NO: 145)

(SEQ ID NO: 120)
```
  1 ACTGCTGGCC CTCTCCTGGT GCCGTTCACC CTCAACTTCA CCATCACCAA
 51 CCTGAAGTAC GAGGAGGACA TGCATTGCCC TGGCTCCAGG AAGTTCAACA
101 CCACAGAGAG AGTCCTGCAG AGTCTGCATG GTCCCATGTT CAAGAACACC
151 AGTGTTGGCC CTCTGTACTC TGGCTGCAGA CTGACCTTGC TCAGGTCCGA
201 GAAGGATGGA GCAGCCACTG GAGTGGATGC CATCTGCACC CACCGTCTTG
251 ACCCCAAAAG CCCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATCN GANCTCTGNG CCCACCACCA
401 GCACTCCTGG GACCTCCACA GTGNACNTNG GNACCTCNGG GACTCCATCC
451 TCCNTCCCCN GCCNCACA
```

(SEQ ID NO: 121)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGNG NGTNCTGCAG GGTCTGCTNN NNCCCNTNTT CAAGAACNCC
151 AGTGTNGGCC NTCTGTACTC TGGCTGCAGA CTGACCTNNC TCAGGNCNGA
201 GAAGNATGGN GCAGCCACTG GANTGGATGC CATCTGCANC CACCNNCNTN
251 ANCCCAAAAG NCCTGGACTG NACAGNGAGC NGCTNTACTG GGAGCTNAGC
301 CANCTGACCA ACAGCATCAC AGAGCTGGGA CCCTACACCC TGGATAGGGA
351 CAGTCTCTAT GTCAATGGTT TCACCCATCG AAGCTCTATG CCCACCACCA
401 GTATTCCTGG GACCTCTGCA GTGCACCTGG AAACCTCTGG GACTCCAGCC
451 TCCCTCCCTG GCCACACA
```

(SEQ ID NO: 122)
```
  1 GCCCCTGGCC CTCTCCTGGT GCCATTCACC CTCAACTTCA CTATCACCAA
 51 CCTGCAGTAT GAGGAGGACA TGCGTCACCC TGGTTCCAGG AAGTTCAACA
101 CCACGGAGAG AGTCCTGCAG GGTCTGCTCA AGCCCTTGTT CAAGAGCACC
151 AGTGTTGGCC CTCTGTACTC TGGCTGCAGA CTGACCTTGC TCAGGCCTGA
201 AAAACGTGGG GCAGCCACCG GCGTGGACAC CATCTGCACT CACCGCCTTG
251 ACCCTCTAAA CCCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATCN GANCTCTGNG CCCACCACCA
401 GCACTCCTGG GACCTCCACA GTGNACNTNG GNACCTCNGG GACTCCATCC
451 TCCNTCCCCN GCCNCACA
```

(SEQ ID NO: 123)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGNG NGTNCTGCAG GGTCTGCTNN NNCCCNTNTT CAAGAACNCC
151 AGTGTNGGCC NTCTGTACTC TGGCTGCAGA CTGACCTNNC TCAGGNCNGA
201 GAAGNATGGN GCAGCCACTG GANTGGATGC CATCTGCANC CACCNNCNTN
251 ANCCCAAAAG NCCTGGACTG NACAGNGAGC NGCTNTACTG GGAGCTNAGC
301 CANCTGACCA ANNNCATCNN NGAGCTGGGN CCCTACACCC TGGACAGGNA
```

TABLE 15-continued

CA125 Repeat Nucleotide Sequence
(SEQ ID NO: 83 thru SEQ ID NO: 145)

```
351  CAGTCTCTAT GTCAATGGTT TTCACCCTCG GAGCTCTGTG CCAACCACCA
401  GCACTCCTGG GACCTCCACA GTGCACCTGG CAACCTCTGG GACTCCATCC
451  TCCCTGCCTG GCCACACA
```

(SEQ ID NO: 124)
```
  1  GCCCCTGTCC CTCTCTTGAT ACCATTCACC CTCAACTTTA CCATCACCAA
 51  CCTGCATTAT GAAGAAAACA TGCAACACCC TGGTTCCAGG AAGTTCAACA
101  CCACGGAGCG GGTCCTGCAG GGTCTGCTTG GTCCCATGTT CAAGAACACA
151  AGTGTCGGCC TTCTGTACTC TGGCTGCAGA CTGACCTTGC TCAGGCCTGA
201  GAAGAATGGG GCAGCCACTG GAATGGATGC CATCTGCAGC CACCGTCTTG
251  ACCCCAAAAG CCCTGGACTG NACAGNGAGC NGCTNTACTG GGAGCTNAGC
301  CANCTGACCA ANNNCATCNN NGAGCTGGGN CCCTACACCC TGGACAGGNA
351  CAGTCTCTAT GTCAATGGTT TCACCCATCN GANCTCTGNG CCCACCACCA
401  GCACTCCTGG GACCTCCACA GTGNACNTNG GNACCTCNGG GACTCCATCC
451  TCCNTCCCCN GCCNCACA
```

(SEQ ID NO: 125)
```
  1  NCNNCTGNCC CTCTCCTGNT NCCNTTCACC NTCAACTTNA CCATCACCAA
 51  CCTGCANTAN GNGGANNACA TGCNNCNCCC NGGNTCCAGG AAGTTCAACA
101  CCACNGAGNG NGTNCTGCAG GGTCTGCTNN NNCCCNTNTT CAAGAACNCC
151  AGTGTNGGCC NTCTGTACTC TGGCTGCAGA CTGACCTNNC TCAGGNCNGA
201  GAAGNATGGN GCAGCCACTG GANTGGATGC CATCTGCANC CACCNNCNTN
251  ANCCCAAAAG NCCTGGACTG NACAGNGAGC NGCTNTACTG GGAGCTNAGC
301  CANCTGACCA ANNNCATCNN NGAGCTGGGN CCCTACACCC TGGACAGGNA
351  CAGTCTCTAT GTCAATGGTT TCACCCATCA GAACTCTGTG CCCACCACCA
401  GTACTCCTGG GACCTCCACA GTGTACTGGG CAACCACTGG GACTCCATCC
451  TCCTTCCCCG GCCACACA
```

(SEQ ID NO: 126)
```
  1  GAGCCTGGCC CTCTCCTGAT ACCATTCACT TTCAACTTTA CCATCACCAA
 51  CCTGCATTAT GAGGAAAACA TGCAACACCC TGGTTCCAGG AAGTTCAACA
101  CCACGGAGAG GGTTCTGCAG GGTCTGCTCA CGCCCTTGTT CAAGAACACC
151  AGTGTTGGCC CTCTGTACTC TGGCTGCAGA CTGACCTTGC TCAGACCTGA
201  GAAGCAGGAG GCAGCCACTG GAGTGGACAC CATCTGTACC CACCGCGTTG
251  ATCCCATCGG ACCTGGACTG NACAGNGAGC NGCTNTACTG GGAGCTNAGC
301  CANCTGACCA ANNNCATCNN NGAGCTGGGN CCCTACACCC TGGACAGGNA
351  CAGTCTCTAT GTCAATGGTT TCACCCATCN GANCTCTGNG CCCACCACCA
401  GCACTCCTGG GACCTCCACA GTGNACNTNG GNACCTCNGG GACTCCATCC
451  TCCNTCCCCN GCCNCACA
```

(SEQ ID NO: 127)
```
  1  NCNNCTGNCC CTCTCCTGNT NCCNTTCACC NTCAACTTNA CCATCACCAA
 51  CCTGCANTAN GNGGANNACA TGCNNCNCCC NGGNTCCAGG AAGTTCAACA
101  CCACNGAGNG NGTNCTGCAG GGTCTGCTNN NNCCCNTNTT CAAGAACNCC
```

TABLE 15-continued

CA125 Repeat Nucleotide Sequence
(SEQ ID NO: 83 thru SEQ ID NO: 145)

```
151  AGTGTNGGCC NTCTGTACTC TGGCTGCAGA CTGACCTNNC TCAGGNCNGA
201  GAAGNATGGN GCAGCCACTG GANTGGATGC CATCTGCANC CACCNNCNTN
251  ANCCCAAAAG NCCTGGACTG NACAGNGAGC NGCTNTACTG GGAGCTNAGC
301  CANCTGACCA ANNNCATCNN NGAGCTGGGN CCCTACACCC TGGACAGGNA
351  CAGTCTCTAT GTCAATGGTT TCACCCATCG GAGCTCTGTG CCAACCACCA
401  GCAGTCCTGG GACCTCCACA GTGCACCTGG CAACCTCTGG GACTCCATCC
451  TCCCTGCCTG GCCACACA
```

(SEQ ID NO: 128)
```
  1  GCCCCTGTCC CTCTCTTGAT ACCATTCACC CTCAACTTTA CCATCACCAA
 51  CCTGCATTAT GAAGAAAACA TGCAACACCC TGGTTCCAGG AAGTTCAACA
101  CCACGGAGAG GGTTCTGCAG GGTCTGCTCA AGCCCTTGTT CAAGAGCACC
151  AGTGTTGGCC CTCTGTACTC TGGCTGCAGA CTGACCTTGC TCAGACCTGA
201  GAAACATGGG GCAGCCACTG GAGTGGACGC CATCTGCACC CTCCGCCTTG
251  ATCCCACTGG TCCTGGACTG NACAGNGAGC NGCTNTACTG GGAGCTNAGC
301  CANCTGACCA ANNNCATCNN NGAGCTGGGN CCCTACACCC TGGACAGGNA
351  CAGTCTCTAT GTCAATGGTT TCACCCATCN GANCTCTGNG CCCACCACCA
401  GCACTCCTGG GACCTCCACA GTGNACNTNG GNACCTCNGG GACTCCATCC
451  TCCNTCCCCN GCCNCACA
```

(SEQ ID NO: 129)
```
  1  NCNNCTGNCC CTCTCCTGNT NCCNTTCACC NTCAACTTNA CCATCACCAA
 51  CCTGCANTAN GNGGANNACA TGCNNCNCCC NGGNTCCAGG AAGTTCAACA
101  CCACNGAGNG NGTNCTGCAG GGTCTGCTNN NNCCCNTNTT CAAGAACNCC
151  AGTGTNGGCC NTCTGTACTC TGGCTGCAGA CTGACCTNNC TCAGGNCNGA
201  GAAGNATGGN GCAGCCACTG GANTGGATGC CATCTGCANC CACCNNCNTN
251  ANCCCAAAAG NCCTGGACTG NACAGNGAGC NGCTNTACTG GGAGCTNAGC
301  CANCTGACCA ANNNCATCNN NGAGCTGGGN CCCTACACCC TGGACAGGNA
351  CAGTCTCTAT GTCAATGGTT TCACCCATCG GACCTCTGTG CCCACCACCA
401  GCACTCCTGG GACCTCCACA GTGCACCTGG CAACCTCTGG GACTCCATCC
451  TCCCTGCCTG GCCACACA
```

(SEQ ID NO: 130)
```
  1  GCCCCTGTCC CTCTCTTGAT ACCATTCACC CTCAACTTTA CCATCACCAA
 51  CCTGCAGTAT GAGGAGGACA TGCATCGCCC TGGATCTAGG AAGTTCAACA
101  CCACAGAGAG GGTCCTGCAG GGTCTGCTTA GTCCCATTTT CAAGAACTCC
151  AGTGTTGGCC CTCTGTACTC TGGCTGCAGA CTGACCTCTC TCAGGCCCGA
201  GAAGGATGGG GCAGCAACTG GAATGGATGC TGTCTGCCTC TACCACCCTA
251  ATCCCAAAAG ACCTGGACTG NACAGNGAGC NGCTNTACTG GGAGCTNAGC
301  CANCTGACCA ANNNCATCNN NGAGCTGGGN CCCTACACCC TGGACAGGNA
351  CAGTCTCTAT GTCAATGGTT TCACCCATCN GANCTCTGNG CCCACCACCA
401  GCACTCCTGG GACCTCCACA GTGNACNTNG GNACCTCNGG GACTCCATCC
451  TCCNTCCCCN GCCNCACA
```

TABLE 15-continued

CA125 Repeat Nucleotide Sequence
(SEQ ID NO: 83 thru SEQ ID NO: 145)

(SEQ ID NO: 131)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGNG NGTNCTGCAG GGTCTGCTNN NNCCCNTNTT CAAGAACNCC
151 AGTGTNGGCC NTCTGTACTC TGGCTGCAGA CTGACCTNNC TCAGGNCNGA
201 GAAGNATGGN GCAGCCACTG GANTGGATGC CATCTGCANC CACCNNCNTN
251 ANCCCAAAAG NCCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATTG GAGCTCTGGG CTCACCACCA
401 GCACTCCTTG GACTTCCACA GTTGACCTTG AACCTCAGG GACTCCATCC
451 CCCGTCCCCA GCCCCACA
```

(SEQ ID NO: 132)
```
  1 ACTGCTGGCC CTCTCCTGGT GCCATTCACC CTAAACTTCA CCATCACCAA
 51 CCTGCAGTAT GAGGAGGACA TGCATCGCCC TGGATCTAGG AAGTTCAACG
101 CCACAGAGAG GGTCCTGCAG GGTCTGCTTA GTCCCATATT CAAGAACACC
151 AGTGTTGGCC CTCTGTACTC TGGCTGCAGA CTGACCTTGC TCAGACCTGA
201 GAAGCAGGAG GCAGCCACTG GAGTGGACAC CATCTGTACC CACCGCGTTG
251 ATCCCATCGG ACCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATCN GANCTCTGNG CCCACCACCA
401 GCACTCCTGG GACCTCCACA GTGNACNTNG GNACCTCNGG GACTCCATCC
451 TCCNTCCCCN GCCNCACA
```

(SEQ ID NO: 133)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGNG NGTNCTGCAG GGTCTGCTNN NNCCCNTNTT CAAGAACNCC
151 AGTGTNGGCC NTCTGTACTC TGGCTGCAGA CTGACCTNNC TCAGGNCNGA
201 GAAGNATGGN GCAGCCACTG GANTGGATGC CATCTGCANC CACCNNCNTN
251 ANCCCAAAAG NCCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATCG GAGCTTTGGG CTCACCACCA
401 GCACTCCTTG GACTTCCACA GTTGACCTTG AACCTCAGG GACTCCATCC
451 CCCGTCCCCA GCCCCACA
```

(SEQ ID NO: 134)
```
  1 ACTGCTGGCC CTCTCCTGGT GCCATTCACC CTAAACTTCA CCATCACCAA
 51 CCTGCAGTAT GAGGAGGACA TGCATCGCCC TGGCTCCAGG AAGTTCAACA
101 CCACGGAGAG GGTCCTTCAG GGTCTGCTTA CGCCCTTGTT CAGGAACACC
151 AGTGTCAGCT CTCTGTACTC TGGTTGCAGA CTGACCTTGC TCAGGCCTGA
201 GAAGGATGGG GCAGCCACCA GAGTGGATGC TGTCTGCACC CATCGTCCTG
251 ACCCCAAAAG CCCTGGACTG NACAGNGAGC NGCTNTACTG GGAGCTNAGC
301 CANCTGACCA ANNNCATCNN NGAGCTGGGN CCCTACACCC TGGACAGGNA
```

TABLE 15-continued

CA125 Repeat Nucleotide Sequence
(SEQ ID NO: 83 thru SEQ ID NO: 145)

```
351  CAGTCTCTAT GTCAATGGTT TCACCCATCN GANCTCTGNG CCCACCACCA
401  GCACTCCTGG GACCTCCACA GTGNACNTNG GNACCTCNGG GACTCCATCC
451  TCCNTCCCCN GCCNCACA
```

(SEQ ID NO: 135)
```
  1  NCNNCTGNCC CTCTCCTGNT NCCNTTCACC NTCAACTTNA CCATCACCAA
 51  CCTGCANTAN GNGGANNACA TGCNNCNCCC NGGNTCCAGG AAGTTCAACA
101  CCACNGAGNG NGTNCTGCAG GGTCTGCTNN NNCCCNTNTT CAAGAACNCC
151  AGTGTNGGCC NTCTGTACTC TGGCTGCAGA CTGACCTNNC TCAGGNCNGA
201  GAAGNATGGN GCAGCCACTG GANTGGATGC CATCTGCANC CACCNNCNTN
251  ANCCCAAAAG NCCTGGACTG NACAGNGAGC NGCTNTACTG GGAGCTNAGC
301  CANCTGACCA ANNNCATCNN NGAGCTGGGN CCCTACACCC TGGACAGGNA
351  CAGTCTCTAT GTCAATGGTT TCACCCATTG GATCCCTGTG CCCACCAGCA
401  GCACTCCTGG GACCTCCACA GTGGACCTTG GGTCAGGGAC TCCATCCTCC
451  CTCCCCAGCC CCACA
```

(SEQ ID NO: 136)
```
  1  ACTGCTGGCC CTCTCCTGGT ACCATTCACC CTCAACTTCA CCATCACCAA
 51  CCTGCAGTAT GGGGAGGACA TGGGTCACCC TGGCTCCAGG AAGTTCAACA
101  CCACAGAGAG GGTCCTGCAG GGTCTGCTTG GTCCCATATT CAAGAACACC
151  AGTGTTGGCC CTCTGTACTC TGGCTGCAGA CTGACCTCTC TCAGGTCCGA
201  GAAGGATGGA GCAGCCACTG GAGTGGATGC CATCTGCATC CATCATCTTG
251  ACCCCAAAAG CCCTGGACTG NACAGNGAGC NGCTNTACTG GGAGCTNAGC
301  CANCTGACCA ANNNCATCNN NGAGCTGGGN CCCTACACCC TGGACAGGNA
351  CAGTCTCTAT GTCAATGGTT TCACCCATCN GANCTCTGNG CCCACCACCA
401  GCACTCCTGG GACCTCCACA GTGNACNTNG GNACCTCNGG GACTCCATCC
451  TCCNTCCCCN GCCNCACA
```

(SEQ ID NO: 137)
```
  1  NCNNCTGNCC CTCTCCTGNT NCCNTTCACC NTCAACTTNA CCATCACCAA
 51  CCTGCANTAN GNGGANNACA TGCNNCNCCC NGGNTCCAGG AAGTTCAACA
101  CCACNGAGNG NGTNCTGCAG GGTCTGCTNN NNCCCNTNTT CAAGAACNCC
151  AGTGTNGGCC NTCTGTACTC TGGCTGCAGA CTGACCTNNC TCAGGNCNGA
201  GAAGNATGGN GCAGCCACTG GANTGGATGC CATCTGCANC CACCNNCNTN
251  ANCCCAAAAG NCCTGGACTG NACAGNGAGC NGCTNTACTG GGAGCTNAGC
301  CANCTGACCA ANNNCATCNN NGAGCTGGGN CCCTACACCC TGGACAGGNA
351  CAGTCTCTAT GTCAATGGTT TCACCCATCA GACCTTTGCG CCCAACACCA
401  GCACTCCTGG GACCTCCACA GTGGACCTTG GGACCTCAGG GACTCCATCC
451  TCCCTCCCC AGCCCTACA
```

(SEQ ID NO: 138)
```
  1  TCTGCTGGCC CTCTCCTGGT GCCATTCACC CTCAACTTCA CCATCACCAA
 51  CCTGCAGTAC GAGGAGGACA TGCATCACCC AGGCTCCAGG AAGTTCAACA
101  CCACGGAGCG GGTCCTGCAG GGTCTGCTTG GTCCCATGTT CAAGAACACC
```

TABLE 15-continued

CA125 Repeat Nucleotide Sequence
(SEQ ID NO: 83 thru SEQ ID NO: 145)

```
151  AGTGTCGGCC TTCTGTACTC TGGCTGCAGA CTGACCTTGC TCAGGCCTGA

201  GAAGAATGGG GCAGCCACCA GAGTGGATGC TGTCTGCACC CATCGTCCTG

251  ACCCCAAAAG CCCTGGACTG NACAGNGAGC NGCTNTACTG GGAGCTNAGC

301  CANCTGACCA ANNNCATCNN NGAGCTGGGN CCCTACACCC TGGACAGGNA

351  CAGTCTCTAT GTCAATGGTT TCACCCATCN GANCTCTGNG CCCACCACCA

401  GCACTCCTGG GACCTCCACA GTGNACNTNG GNACCTCNGG GACTCCATCC

451  TCCNTCCCCN GCCNCACA
```

(SEQ ID NO: 139)
```
  1  NCNNCTGNCC CTCTCCTGNT NCCNTTCACC NTCAACTTNA CCATCACCAA

51  CCTGCANTAN GNGGANNACA TGCNNCNCCC NGGNTCCAGG AAGTTCAACA

101  CCACNGAGAG GGTTCTGCAG GGTCTGCTCA AGCCCTTGTT CAAGAGCACC

151  AGTGTTGGCC CTCTGTATTC TGGCTGCAGA CTGACCTTGC TCAGGCCTGA

201  GAAGGACGGA GTAGCCACCA GAGTGGACGC CATCTGCACC CACCGCCCTG

251  ACCCCAAAAT CCCTGGGCTA GACAGACAGC AGCTATACTG GGAGCTGAGC

301  CAGCTGACCC ACAGCATCAC TGAGCTGGGA CCCTACACCC TGGATAGGGA

351  CAGTCTCTAT GTCAATGGTT TCACCCAGCG GAGCTCTGTG CCCACCACCA

401  GCACTCCTGG GACTTTCACA GTACAGCCGG AAACCTCTGA GACTCCATCA

451  TCCCTCCCTG GCCCCACA
```

(SEQ ID NO: 140)
```
  1  GCCACTGGCC CTGTCCTGCT GCCATTCACC CTCAATTTTA CCATCACTAA

51  CCTGCAGTAT GAGGAGGACA TGCATCGCCC TGGCTCCAGG AAGTTCAACA

101  CCACGGAGAG GGTCCTTCAG GGTCTGCTTA TGCCCTTGTT CAAGAACACC

151  AGTGTCAGCT CTCTGTACTC TGGTTGCAGA CTGACCTTGC TCAGGCCTGA

201  GAAGGATGGG GCAGCCACCA GAGTGGATGC TGTCTGCACC CATCGTCCTG

251  ACCCCAAAAG CCCTGGACTG GACAGAGAGC GGCTGTACTG GAAGCTGAGC

301  CAGCTGACCC ACGGCATCAC TGAGCTGGGC CCCTACACCC TGGACAGGCA

351  CAGTCTCTAT GTCAATGGTT TCACCCATCA GAGCTCTATG ACGACCACCA

401  GAACTCCTGA TACCTCCACA ATGCACCTGG CAACCTCGAG AACTCCAGCC

451  TCCCTGTCTG GACCTACG
```

(SEQ ID NO: 141)
```
  1  ACCGCCAGCC CTCTCCTGGT GCTATTCACA ATTAACTTCA CCATCACTAA

51  CCTGCGGTAT GAGGAGAACA TGCATCACCC TGGCTCTAGA AAGTTTAACA

101  CCACGGAGAG AGTCCTTCAG GGTCTGCTCA GGCCTGTGTT CAAGAACACC

151  AGTGTTGGCC CTCTGTACTC TGGCTGCAGA CTGACCTTGC TCAGGCCCAA

201  GAAGGATGGG GCAGCCACCA AAGTGGATGC CATCTGCACC TACCGCCCTG

251  ATCCCAAAAG CCCTGGACTG GACAGAGAGC AGCTATACTG GGAGCTGAGC

301  CAGCTAACCC ACAGCATCAC TGAGCTGGGC CCCTACACCC TGGACAGGGA

351  CAGTCTCTAT GTCAATGGTT TCACACAGCG GAGCTCTGTG CCCACCACTA

401  GCATTCCTGG GACCCCCACA GTGGACCTGG GAACATCTGG GACTCCAGTT

451  TCTAAACCTG GTCCCTCG
```

TABLE 15-continued

CA125 Repeat Nucleotide Sequence
(SEQ ID NO: 83 thru SEQ ID NO: 145)

(SEQ ID NO: 142)
```
  1 GCTGCCAGCC CTCTCCTGGT GCTATTCACT CTCAACTTCA CCATCACCAA
 51 CCTGCGGTAT GAGGAGAACA TGCAGCACCC TGGCTCCAGG AAGTTCAACA
101 CCACGGAGAG GGTCCTTCAG GGCCTGCTCA GGTCCCTGTT CAAGAGCACC
151 AGTGTTGGCC CTCTGTACTC TGGCTGCAGA CTGACTTTGC TCAGGCCTGA
201 AAAGGATGGG ACAGCCACTG GAGTGGATGC CATCTGCACC CACCACCCTG
251 ACCCCAAAAG CCCTAGGCTG ACAGAGAGC AGCTGTATTG GGAGCTGAGC
301 CAGCTGACCC ACAATATCAC TGAGCTGGGC CACTATGCCC TGGACAACGA
351 CAGCCTCTTT GTCAATGGTT TCACTCATCG GAGCTCTGTG TCCACCACCA
401 GCACTCCTGG GACCCCCACA GTGTATCTGG GAGCATCTAA GACTCCAGCC
451 TCGATATTTG GCCCTTCA
```

(SEQ ID NO: 143)
```
  1 GCTGCCAGCC ATCTCCTGAT ACTATTCACC CTCAACTTCA CCATCACTAA
 51 CCTGCGGTAT GAGGAGAACA TGTGGCCTGG CTCCAGGAAG TTCAACACTA
101 CAGAGAGGGT CCTTCAGGGC CTGCTAAGGC CCTTGTTCAA GAACACCAGT
151 GTTGGCCCTC TGTACTCTGG CTCCAGGCTG ACCTTGCTCA GGCCAGAGAA
201 AGATGGGGAA GCCACCGGAG TGGATGCCAT CTGCACCCAC CGCCCTGACC
251 CCACAGGCCC TGGGCTGGAC AGAGAGCAGC TGTATTTGGA GCTGAGCCAG
301 CTGACCCACA GCATCACTGA GCTGGGCCCC TACACACTGG ACAGGACAG
351 TCTCTATGTC AATGGTTTCA CCCATCGGAG CTCTGTACCC ACCACCAGC
```

(SEQ ID NO: 144)
```
  1 ACCGGGGTGG TCAGCGAGGA GCCATTCACA CTGAACTTCA CCATCAACAA
 51 CCTGCGCTAC ATGGCGGACA TGGGCCAACC CGGCTCCCTC AAGTTCAACA
101 TCACAGACAA CGTCATGAAG CACCTGCTCA GTCCTTTGTT CCAGAGGAGC
151 AGCCTGGGTG CACGGTACAC AGGCTGCAGG GTCATCGCAC TAAGGTCTGT
201 GAAGAACGGT GCTGAGACAC GGGTGGACCT CCTCTGCACC TACCTGCAGC
251 CCCTCAGCGG CCCAGGTCTG CCTATCAAGC AGGTGTTCCA TGAGCTGAGC
301 CAGCAGACCC ATGGCATCAC CCGGCTGGGC CCCTACTCTC TGGACAAAGA
351 CAGCCTCTAC CTTAACGGTT ACAATGAACC TGGTCTAGAT GAGCCTCCTA
401 CAACTCCCAA GCCAGCCACC ACATTCCTGC CTCCTCTGTC AGAAGCCACA
451 ACA
```

(SEQ ID NO: 145)
```
  1 GCCATGGGGT ACCACCTGAA GACCCTCACA CTCAACTTCA CCATCTCCAA
 51 TCTCCAGTAT TCACCAGATA TGGGCAAGGG CTCAGCTACA TTCAACTCCA
101 CCGAGGGGGT CCTTCAGCAC CTGCTCAGAC CCTTGTTCCA GAAGAGCAGC
151 ATGGGCCCCT TCTACTTGGG TTGCCAACTG ATCTCCCTCA GGCCTGAGAA
201 GGATGGGGCA GCCACTGGTG TGGACACCAC CTGCACCTAC CACCCTGACC
251 CTGTGGGCCC CGGGCTGGAC ATACAGCAGC TTTACTGGGA GCTGAGTCAG
301 CTGACCCATG GTGTCACCCA ACTGGGCTTC TATGTCCTGG ACAGGGATAG
```

TABLE 15-continued

CA125 Repeat Nucleotide Sequence
(SEQ ID NO: 83 thru SEQ ID NO: 145)

```
351  CCTCTTCATC AATGGCTATG CACCCCAGAA TTTATCAATC CGGGGCGAGT

401  ACCAGATAAA TTTCCACATT GTCAACTGGA ACCTCAGTAA TCCAGACCCC

451  ACATCCTCAG AGTAC
```

TABLE 16

CA125 Repeat Domains
(SEQ ID NO: 146)

```
1   ATVPFMVPFTLNFTITNLQYEEDMRHPGSRKFNATERELQGLLKPLFRNSSLEYLYSGCRLASLRPEKDSSAMAVDAIC
    THRPDPEDLGLDRERLYWELSNLTNGIQELGPYTLDRNSLYVNGFTHRSSMPTTSTPGTSTVDVGTSGTPSSSPSPT

AAGPLLMPFTLNFTITNLQYEEDMRRTGSRKFNTMESVLQGLLKPLFKNTSVGPLYSGCRLTLLRPEKDGAATGVDAIC
    THRLDPKSPGLNREQLYWELSKLTNDIEELGPYTLDRNSLYVNGFTHQSSVSTTSTPGTSTVDLRTSGTPSSLSSPTIM

AAGPLLVPFTLNFTITNLQYGEDMGHPGSRKFNTTERVLQGLLGPIFKNTSVGPLYSGCRLTSLRSEKDGAATGVDAIC
    IHHLDPKSPGLNRERLYWELSQLTNGIKELGPYTLDRNSLYVNGFTHRTSVPTSSTPGTSTVDLGTSGTPFSLPSPA

TAGPLLVLFTLNFTITNLKYEEDMHRPGSRKFNTTERVLQTLLGPMFKNTSVGLLYSGCRLTLLRSEKDGAATGVDAIC
    THRLDPKSPGLDREQLYWELSQLTNGIKELGPYTLDRNSLYVNGFTHWIPVPTSSTPGTSTVDLG.SGTPSSLPSPT

5   AAGPLLVPFTLNFTITNLQYEEDMHHPGSRKFNTTERVLQGLLGPMFKNTSVGLLYSGCRLTLLRSEKDGAATGVDAIC
    THRLDPKSPGVDREQLYWELSQLTNGIKELGPYTLDRNSLYVNGFTHQTSAPNTSTPGTSTVDLGTSGTPSSLPSPT

SAGPLLVPFTLNFTITNLQYEEDMRHPGSRKFNTTERVLQGLLKPLFKSTSVGPLYSGCRLTLLRSEKDGAATGVDAIC
    THRLDPKSPGVDREQLYWELSQLTNGIKELGPYTLDRNSLYVNGFTHQTSAPNTSTPGTSTVDLGTSGTPSSLPSPT

SAGPLLVPFTLNFTITNLQYEEDMHHPGSRKFNTTERVLQGLLGPMFKNTSVGLLYSGCRLTLLRPEKNGAATGMDAIC
    SHRLDPKSPGLNREQLYWELSQLTHGIKELGPYTLDRNSLYVNGFTHRSSVAPTSTPGTSTVDLGTSGTPSSLPSPT

TAVPLLVPFTLNFTITNLQYGEDMRHPGSRKFNTTERVLQGLLGPLFKNSSVGPLYSGCRLISLRSEKDGAATGVDAIC
    THHLNPQSPGLDREQLYWQLSQMTNGIKELGPYTLDRNSLYVNGFTHRSSGLTTSTPWTSTVDLGTSGTPSPVPSPT

TAGPLLVPFTLNFTITNLQYEEDMHRPGSRKFNATERVLQGLLSPIFKNSSVGPLYSGCRLTSLRPEKDGAATGMDAVC
    LYHPNPKRPGLDREQLYWELSQLTHNITELGPYSLDRDSLYVNGFTHQNSVPTTSTPGTSTVYWATTGTPSSFPGHT

10  EPGPLLIPFTFNFTITNLHYEENMQHPGSRKFNTTERVLQGLLKPLFKNTSVGPLYSGCRLTSLRPEKDGAATGMDAVC
    LYHPNPKRPGLDREQLYCELSQLTHNITELGPYSLDRDSLYVNGFTHQNSVPTTSTPGTSTVYWATTGTPSSFPGHT

EPGPLLIPFTFNFTITNLHYEENMQHPGSRKFNTTERVLQGLLKPLFKNTSVGPLYSGCRLTLLRPEKHEAATGVDTIC
    THRVDPIGPGLDRERLYWELSQLTNSITELGPYTLDRDSLYVNGFNPRSSVPTTSTPGTSTVHLATSGTPSSLPGHT

APVPLLIPFTLNFTITNLHYEENMQHPGSRKFNTTERVLQGLLKPLFKNTSVGPLYSGCRLTLLRPEKHEAATGVDTIC
    THRVDPIGPGLDREXLYWELSXLTXXIXELGPYXLDRXSLYVNGFXXXXXXXXXTSTPGTSXVXLXTSGTPXXXPXXT

SAGPLLVPFTLNFTITNLQYEEDMHHPGSRKFNTTERVLQGLLGPMFKNTSVGLLYSGCRLTLLRPEKNGAATGMDAIC
    SHRLDPKSPGLDREQLYWELSQLTHGIKELGPYTLDRNSLYVNGFTHRSSVAPTSTPGTSTVDLGTSGTPSSLPSPT

TAVPLLVPFTLNFTITNLQYGEDMRHPGSRKFNTTERVLQGLLGPLFKNSSVGPLYSGCRLISLRSEKDGAATGVDAIC
    THHLNPQSPGLDREQLYWQLSQMTNGIKELGPYTLDRNSLYVNGFTHRSSGLTTSTPWISTVDLGTSGTPSPVPSPT

15  TAGPLLVPFTLNFTITNLQYEEDMHRPGSRKFNTTERVLQGLLSPIFKNSSVGPLYSGCRLTSLRPEKDGAATGMDAVC
    LYHPNPKRPGLDREQLYWELSQLTHNITELGPYSLDRDSLYVNGFTHQSSMTTTRTPDTSTMHLATSRTPASLSGPT

TASPLLVLFTINCTITNLQYEEDMRRTGSRKFNTMESVLQGLLKPLFKNTSVGPLYSGCRLTLLRPKKDGAATGVDAIC
    THRLDPKSPGLNREQLYWELSKLTNDIEELGPYTLDRNSLYVNGFTHQSSVSTTSTPGTSTVDLRTSGTPSSLSSPTIM

XXXPLLXPFTLNFTITNLXYEEXMXXPGSRKFNTTERVLQGLLRPLFKNTSVSSLYSGCRLTLLRPEKDGAATRVDAAC
    TYRPDPKSPGLDREQLYWELSQLTHSITELGPYTLDRVSLYVNGFNPRSSVPTTSTPGTSTVHLATSGTPSSLPGHT

APVPLLIPFTLNFTITNLHYEENMQHPGSRKFNTTERVLQGLLRPLFKSTSVGPLYSGCRLTLLRPEKHGAATGVDAIC
    TLRLDPTGPGLDRERLYWELSQLTNSVTELGPYTLDRDSLYVNGFTQRSSVPTTSIPGTSAVHLETSGTPASLPGHT

APGPLLVPFTLNFTITNLQYEVDMRHPGSRKFNTTERVLQGLLKPLFKSTSVGPLYSGCRLTLLRPEKRGAATGVDTIC
    THRLDPLNPGLDREQLYWELSKLTRGIIELGPYLLDRGSLYVNGFTHRNFVPTISTPGTSTVHLGTSETPSSLPRPI

20  VPGPLLVPFTLNFTITNLQYEEAMRHPGSRKFNTTERVLQGLLRPLFKNTSIGPLYSSCRLTLLRPEKDKAATRVDAIC
    THHPDPQSPGLNREQLYWELSQLTHGITELGPYTLDRDSLYVDGFTHWSPIPTTSTPGTSIVNLGTSGIPPSLPETT

XXXPLLXPFTLNFTITNLXYEEXMXXPGSRKFNTTERVLQGLLKPLFRNSSLEYLYSGCRLASLRPEKDSSAMAVDAIC
    THRPDPEDLGLDRERLYWELSNLTNGIQELGPYTLDRNSLYVNGFTHRSSFLTTSTPWTSTVDLGTSGTPSPVPSPT
```

TABLE 16-continued

CA125 Repeat Domains
(SEQ ID NO: 146)

TAGPLLVPFTLNFTITNLQYEEDMHRPGSRKFNTTERVLQGLLTPLFKNTSVGPLYSGCRLTLLRPEKQEAATGVDTIC
THRVDPIGPGLDRERLYWELSQLTNSITELGPYTLDRDSLYVNGFNPWSSVPTTSTPGTSTVHLATSGIPSSLPGHT

APVPLLIPFTLNFTITDLHYEENMQHPGSRKFNTTERVLQGLLKPLFKSTSVGPLYSGCRLTLLRPEKHGAATGVDAIC
TLRLDPTGPGLDRERLYWELSQLTNSVTELGPYTLDRDSLYVNGFTHRSSVPTTSIPGTSAVHLETSGTPASLPGHT

APGPLLVPFTLNFTITNLQYEEDMRHPGSRKFSTTERVLQGLLKPLFKNTSVSSLYSGCRLTLLRPEKDGAATRVDAVC
THRPDPKSPGLDRERLYWKLSQLTHGITELGPYTLDRHSLYVNGFTHQSSMTTTRTPDTSTMHLATSRTPASLSGPT

TASPLLVLFTINFTITNQRYEENMHHPGSRKFNTTERVLQGLLRPVFKNTSVGPLYSGCRLTLLRPKKDGAATKVDAIC
TYRPDPKSPGLDREQLYWELSQLTHSITELGPYTQDRDSLYVNGFTHRSSVPTTSIPGTSAVHLETSGTPASLPGHT

APGPLLVPFTLNFTITNLQYEEDMRHPGSRKFNTTERVLQGLLKPLFKSTSVGPLYSGCRLTLLRPEKRGAATGVDTIC
THRLDPLNPGLDREQLYWELSKLTRGIIELGPYLLDRGSLYVNGFTHRTSVPTTSTPGTSTVDLGTSGTPFSLPSPA

XXXPLLXPFTLNFTITNLXYEEXMXXPGSRKFNTTERVLQTLLGPMFKNTSVGLLYSGCRLTLLRSEKDGAATGVDAIC
THRLDPKSPGVDREQLYWELSQLTNGIKELGPYTLDRNSLYVNGFTHWIPVPTSSTPGTSTVDLG.SGTPSLPSSPT

TAGPLLVPFTLNFTITNLKYEEDMHCPGSRKFNTTERVLQSLLGPMFKNTSVGPLYSGCRLTLLRSEKDGAATGVDAIC
THRLDPKSPGVDREQLYWELSQLTNGIKELGPYTLDRNSLYVNGFTHQTSAPNTSTPGTSTVDLGTSGTPSSLPSPT

XXXPLLXPFTLNFTITNLXYEEXMXXPGSRKFNTTERVLQGLLXPXFKXTSVGXLYSGCRLTLLRXEKXXAATXVDXXC
XXXXDPXXPGLDREXLYWELSXLTXXIXELGPYXLDRXSLYVNGFTHWIPVPTSSTPGTSTVDLG.SGTPSSLPSPT

TAGPLLVPFTLNFTITNLKYEEDMHCPGSRKFNTTERVLQSLLGPMFKNTSVGPLYSGCRLTSLRSEKDGAATGVDAIC
THRVDPKSPGVDREQLYWELSQLTNGIKELGPYTLDRNSLYVNGFTHQTSAPNTSTPGTSTVDLGTSGTPSSLPSPT

SAGPLLVPFTLNFTITNLQYEEDMHHPGSRKFNTTERVLQGLLGPMFKNTSVGLLYSGCRLTLLRPEKNGAATGMDAIC
THRLDPKSPGLDREXLYWELSXLTXXIXELGPYXLDRXSLYVNGFXXXXXXXXXTSTPGTSXVXLXTSGTPXXXPXXT

XXXPLLXPFTLNFTITNLXYEEXMXXPGSRKFNTTERVLQGLLKPLFRNSSLEYLYSGCRLASLRPEKDSSAMAVDAIC
THRPDPEDLGLDRERLYWELSNLTNGIQELGPYTLDRNSLYVNGFTHRSSMPTTSTPGTSTVDVGTSGTPSSSPSPT

TAGPLLIPFTLNFTITNLQYGEDMGHPGSRKFNTTERVLQGLLGPIFKNTSVGPLYSGCRLTSLRSEKDGAATGVDAIC
IHHLDPKSPGLNRERLYWELSQLTNGIKELGPYTLDRNSLYVNGFTHRTSVPTTSTPGTSTVDLGTSGTPFSLPSPA

TAGPLLVLFTLNFTITNLKYEEDMHRPGSRKFNTTERVLQTLLGPMFKNTSVGLLYSGCRLTLLRSEKDGAATGVDAIC
THRLDPKSPGLDREXLYWELSXLTXXIXELGPYXLDRXSLYVNGFXXXXXXXXXTSTPGTSXVXLXTSGTPXXXPXXT

XXXPLLXPFTLNFTITNLXYEEXMXXPGSRKFNTTERVLQGLLRPVFKNTSVGPLYSGCRLTLLRPKKDGAATKVDAIC
TYRPDPKSPGLDREQLYWELSQLTHSITELGPYTQDRDSLYVNGFTHRSSVPTTSIPGTSAVHLETTGTPSSFPGHT

EPGPLLIPFTFNFTITNLRYEENMQHPGSRKFNTTERVLQGLLTPLFKNTSVGPLYSGCRLTLLRPEKQEAATGVDTIC
THRVDPIGPGLDRERLYWELSQLTNSITELGPYTLDRDSLYVDGFNPWSSVPTTSTPGTSTVHLATSGTPSLPGHT

APVPLLIPFTLNFTITDLHYEENMQHPGSRKFNTTERVLQGLLKPLFKSTSVGPLYSGCRLTLLRPEKHGAATGVDAIC
TLRLDPTGPGLDRERLYWELSQLTNSITELGPYTLDRDSLYVNGFNPWSSVPTTSTPGTSTVHLATSGTPSSLPGHT

TAGPLLVPFTLNFTITNLKYEEDMHCPGSRKFNTTERVLQSLHGPMFKNTSVGPLYSGCRLTLLRSEKDGAATGVDAIC
THRLDPKSPGLDREXLYWELSXLTXXIXELGPYXLDRXSLYVNGFXXXXXXXXXTSTPGTSXVXLXTSGTPXXXPXXT

XXXPLLXPFTLNFTITNLXYEEXMXXPGSRKFNTTERVLQGLLXPXFKXTSVGXLYSGCRLTLLRXEKXXAATXVDXXC
XXXXDPXXPGLDREXLYWELSXLTNSITELGPYTLDRDSLYVNGFTHRSSMPTTSIPGTSAVHLETSGTPASLPGHT

APGPLLVPFTLNFTITNLQYEEDMRHPGSRKFNTTERVLQGLLKPLFKSTSVGPLYSGCRLTLLRPEKRGAATGVDTIC
THRLDPLNPGLDREXLYWELSXLTXXIXELGPYXLDRXSLYVNGFXXXXXXXXXTSTPGTSXVXLXTSGTPXXXPXXT

XXXPLLXPFTLNFTITNLXYEEXMXXPGSRKFNTTERVLQGLLXPXFKXTSVGXLYSGCRLTLLRXEKXXAATXVDXXC
XXXXDPXXPGLDREXLYWELSXLTXXIXELGPYXLDRXSLYVNGFHPRSSVPTTSTPGTSTVHLATSGTPSSLPGHT

APVPLLIPFTLNFTITNLHYEENMQHPGSRKFNTTERVLQGLLGPMFKNTSVGLLYSGCRLTLLRPEKNGAATGMDAIC
SHRLDPKSPGLDREXLYWELSXLTXXIXELGPYXLDRXSLYVNGFXXXXXXXXXTSTPGTSXVXLXTSGTPXXXPXXT

XXXPLLXPFTLNFTITNLXYEEXMXXPGSRKFNTTERVLQGLLXPXFKXTSVGXLYSGCRLTLLRXEKXXAATXVDXXC
XXXXDPXXPGLDREXLYWELSXLTXXIXELGPYXLDRXSLYVNGFTHQNSVPTTSTPGTSTVYWATTGTPSSFPGHT

EPGPLLIPFTFNFTITNLHYEENMQHPGSRKFNTTERVLQGLLTPLFKNTSVGPLYSGCRLTLLRPEKQEAATGVDTIC
THRVDPIGPGLDREXLYWELSXLTXXIXELGPYXLDRXSLYVNGFXXXXXXXXXTSTPGTSXVXLXTSGTPXXXPXXT

XXXPLLXPFTLNFTITNLXYEEXMXXPGSRKFNTTERVLQGLLXPXFKXTSVGXLYSGCRLTLLRXEKXXAATXVDXXC
XXXXDPXXPGLDREXLYWELSXLTXXIXELGPYXLDRXSLYVNGFTHRSSVPTTSPGTSTVHLATSGTPSSLPGHT

APVPLLIPFTLNFTITNLHYEENMQHPGSRKFNTTERVLQGLLKPLFKSTSVGPLYSGCRLTLLRPEKHGAATGVDAIC
TLRLDPTGPGLDREXLYWELSXLTXXIXELGPYXLDRXSLYVNGFXXXXXXXXXTSTPGTSXVXLXTSGTPXXXPXXT

XXXPLLXPFTLNFTITNLXYEEXMXXPGSRKFNTTERVLQGLLXPXFKXTSVGXLYSGCRLTLLRXEKXXAATXVDXXC
XXXXPDXXPGLDREXLYWELSXLTXXIXELGPYXLDRXSLYVNGFTHRTSVPTTSTPGTSTVHLATSGTPSSLPGHT

TABLE 16-continued

CA125 Repeat Domains
(SEQ ID NO: 146)

```
     APVPLLIPFTLNFTITNLQYEEDMHRPGSRKFNTTERVLQGLLSPIFKNSSVGPLYSGCRLTSLRPEKDGAATGMDAVC
     LYHPNPKRPGLDREXLYWELSXLTXXIXELGPYXLDRXSLYVNGFXXXXXXXXXTSTPGTSXVXLXTSGTPXXXPXXT

XXXPLLXPFTLNFTITNLXYEEXMXXPGSRKFNTTERVLQGLLXPXFKXTSVGXLYSGCRLTLLRXEKXXAATXVDXXC
     XXXXDPXXPGLDREXLYWELSXLTXXIXELGPYXLDRXSLYVNGFTHWSSGLTTSTPWISTVDLGTSGTPSPVPSPT

50  TAGPLLVPFTLNFTITNLQYEEDMHRPGSRKFNATERVLQGLLSPIFKNTSVGPLYSGCRLTLLRPEKQEAATGVDTIC
     THRVDPIGPGLDREXLYWELSXLTXXIXELGPYXLDRXSLYVNGFXXXXXXXXXTSTPGTSXVXLXTSGTPXXXPXXT

XXXPLLXPFTLNFTITNLXYEEXMXXPGSRKFNTTERVLQGLLXPXFKXTSVGXLYSGCRLTLLRXEKXXAATXVDXXC
     XXXXDPXXPGLDREXLYWELSXLTXXIXELGPYXLDRXSLYVNGFTHRSFGLTTSTPWTSTVDLGTSGTPSPVPSPT

TAGPLLVPFTLNFTITNLQYEEDMHRPGSRKFNTTERVLQGLLTPLFRNTSVSSLYSGCRLTLLRPEKDGAATRVDAVC
     THRPDPKSPGLDREXLYWELSXLTXXIXELGPYXLDRXSLYVNGFXXXXXXXXXTSTPGTSXVXLXTSGTPXXXPXXT

XXXPLLXPFTLNFTITNLXYEEXMXXPGSRKFNTTERVLQGLLXPXFKXTSVGXLYSGCRLTLLRXEKXXAATXVDXXC
     XXXXDPXXPGLDREXLYWELSXLTXXIXELGPYXLDRXSLYVNGFTHWIPVPTSSTPGTSTVDLG.SGTPSSLPSPT

TAGPLLVPFTLNFTITNLQYGEDMGHPGSRKFNTTERVLQGLLGPIFKNTSVGPLYSGCRLTSLRSEKDGAATGVDAIC
     IHHLDPKSPGLDREXLYWELSXLTXXIXELGPYXLDRXSLYVNGFXXXXXXXXXTSTPGTSXVXLXTSGTPXXXPXXT

55  XXXPLLXPFTLNFTITNLXYEEXMXXPGSRKFNTTERVLQGLLXPXFKXTSVGXLYSGCRLTLLRXEKXXAATXVDXXC
     XXXXDPXXPGLDREXLYWELSXLTXXIXELGPYXLDRXSLYVNGFTHQTFAPNTSTPGTSTVDLGTSGTPSSLPSPT

SAGPLLVPFTLNFTITNLQYEEDMHHPGSRKFNTTERVLQGLLGPMFKNTSVGLLYSGCRLTLLRPEKNGAATRVDAVC
     THRPDPKSPGLDREXLYWELSXLTXXIXELGPYXLDRXSLYVNGFXXXXXXXXXTSTPGTSXVXLXTSGTPXXXPXXT

XXXPLLXPFTLNFTITNLXYEEXMXXPGSRKFNTTERVLQGLLKPLFKSTSVGPLYSGCRLTLLRPEKDGVATRVDAIC
     THRPDPKIPGLDRQQLYWELSQLTHSITELGPYTLDRDSLYVNGFTQRSSVPTTSTPGTFTVQPETSETPSSLPGPT

ATGPVLLPFTLNFTITNLQYEEDMHRPGSRKFNTTERVLQGLLMPLFKNTSVSSLYSGCRLTLLRPEKDGAATRVDAVC
     THRPDPKSPGLDRERLYWKLSQLTHGITELGPYTLDRHSLYVNGFTHQSSMTTTRTPDTSTMHLATSRTPASLSGPT

TASPLLVLFTINFTITNLRYEENMHHPGSRKFNTTERVLQGLLRPVFKNTSVGPLYSGCRLTLLRPKKDGAATKVDAIC
     TYRPDPKSPGLDREQLYWELSQLTHSITELGPYTQDRDSLYNVGFTQRSSVPTTSVPGTPTVDLGTSGTPVSKPGPS

60  AASPLLVLFTLNGTITNLRYEENMQHPGSRKFNTTERVLQGLLRSLFKSTSVGPLYSGCRLTLLRPEKDGTATGVDAIC
     TKHPDPKSPRLDREQLYWELSQLTHNITELGHYALDNDSLFVNGFTHRSSVSTTSTPGTPTVYLGASKTPASIFGPS

AASHLLILFTLNFTITNIAYEENMW.PGSRKFNTTERVLQGLLRPLFKNTSVGPLYSGSRLTLLRPEKDGEATGVDAIC
     THRPDPTGPGLDREOLYLELSQLTHSITELGPYTLDRDSLYVNGFTHRSSVPTTS....................

TGVVSEEQFTLNFTINNLRYMADMGQPGSLKFNITDNVMKHLLSPLFQRSSLGARYTGCRVIALRSVKNGAETRVDLLC
     TYLQPLSGPGLPIKQVFHELSQQTHGITRLGPYSLDKDSLYLNGYNEPGLDEPPTTPKPATTFLPPLSEATT.....

AMGYHLKTLTLNFTISNLQYSPDMGKGSATFNSTEGVLQHLLRPLFQKSSM.GPFYLGCQLISLRPEKDGAATGVDTTC
     TYHPDPVGPGLDIQQLYWELSQLTHGVTQLGFYVLDRDSLFINGYAPQNLSIRGEYQINFHIVNWNLSNPDPTSSEY
```

TABLE 17

Carboxy Terminal Nucleotide Sequence
(SEQ ID NO: 147)

```
  1  GCCATGGGGT ACCACCTGAA GACCCTCACA CTCAACTTCA CCATCTCCAA
 51  TCTCCAGTAT TCACCAGATA TGGGCAAGGG CTCAGCTACA TTCAACTCCA
101  CCGAGGGGGT CCTTCAGCAC CTGCTCAGAC CCTTGTTCCA GAAGAGCAGC
151  ATGGGCCCCT TCTACTTGGG TTGCCAACTG ATCTCCCTCA GGCCTGAGAA
201  GGATGGGGCA GCCACTGGTG TGGACACCAC CTGCACCTAC CACCCTGACC
251  CTGTGGGCCC CGGGCTGGAC ATACAGCAGC TTTACTGGGA GCTGAGTCAG
301  CTGACCCATG GTGTCACCCA ACTGGGCTTC TATGTCCTGG ACAGGGATAG
351  CCTCTTCATC AATGGCTATG CACCCCAGAA TTTATCAATC CGGGGCGAGT
401  ACCAGATAAA TTTCCACATT GTCAACTGGA ACCTCAGTAA TCCAGACCCC
451  ACATCCTCAG AGTACATCAC CCTGCTGAGG GACATCCAGG ACAAGGTCAC
```

TABLE 17-continued

Carboxy Terminal Nucleotide Sequence
(SEQ ID NO: 147)

```
 501 CACACTCTAC AAAGGCAGTC AACTACATGA CACATTCCGC TTCTGCCTGG
 551 TCACCAACTT GACGATGGAC TCCGTGTTGG TCACTGTCAA GGCATTGTTC
 601 TCCTCCAATT TGGACCCCAG CCTGGTGGAG CAAGTCTTTC TAGATAAGAC
 651 CCTGAATGCC TCATTCCATT GGCTGGGCTC CACCTACCAG TTGGTGGACA
 701 TCCATGTGAC AGAAATGGAG TCATCAGTTT ATCAACCAAC AAGCAGCTCC
 751 AGCACCCAGC ACTTCTACCT GAATTTCACC ATCACCAACC TACCATATTC
 801 CCAGGACAAA GCCCAGCCAG GCACCACCAA TTACCAGAGG AACAAAAGGA
 851 ATATTGAGGA TGCGCTCAAC CAACTCTTCC GAAACAGCAG CATCAAGAGT
 901 TATTTTTCTG ACTGTCAAGT TTCAACATTC AGGTCTGTCC CCAACAGGCA
 951 CCACACCGGG GTGGACTCCC TGTGTAACTT CTCGCCACTG GCTCGGAGAG
                                                        *
1001 TAGACAGAGT TGCCATCTAT GAGGAATTTC TGCGGATGAC CCGGAATGGT
1051 ACCCAGCTGC AGAACTTCAC CCTGGACAGG AGCAGTGTCC TTGTGGATGG
1101 GTATTCTCCC AACAGAAATG AGCCCTTAAC TGGGAATTCT GACCTTCCCT
1151 TCTGGGCTGT CATCCTCATC GGCTTGGCAG GACTCCTGGG ACTCATCACA
1201 TGCCTGATCT GCGGTGTCCT GGTGACCACC CGCCGGCGGA AGAAGGAAGG
1251 AGAATACAAC GTCCAGCAAC AGTGCCCAGG CTACTACCAG TCACACCTAG
1301 ACCTGGAGGA TCTGCAATGA CTGGAACTTG CCGGTGCCTG GGTGCCTTT
1351 CCCCCAGCCA GGGTCCAAAG AAGCTTGGCT GGGGCAGAAA TAAACCATAT
1401 TGGTCGGAAA AAAAAAAAA AA
```

TABLE 18

Carboxy Terminal Amino Acid Sequence
(SEQ ID NO: 148)

```
  1 AMGYHLKTLT LNFTISNLQY SPDMGKGSAT FNSTEGVLQH LLRPLFQKSS
 51 MGPFYLGCQL ISLRPEKDGA ATGVDTTCTY HPDPVGPGLD IQQLYWELSQ
101 LTHGVTQLGF YVLDRDSLFI NGYAPQNLSI RGEYQINFHI VNWNLSNPDP
           *
151 TSSEYITLLR DIQDKVTTLY KGSQLHDTFR FCLVTNLTMD SVLVTVKALF
201 SSNLDPSLVE QVFLDKTLNA SFHWLGSTYQ LVDIHVTEME SSVYQPTSSS
251 STQHFYLNFT ITNLPYSQDK AQPGTTNYQR NKRNIEDALN QLFRNSSIKS
301 YFSDCQVSTF RSVPNRHHTG VDSLCNFSPL ARRVDRVAIY EEFLRMTRNG
351 TQLQNFTLDR SSVLVDGYSP NRNEPLTGNS DLPFWAVILI GLAGLLGLIT
401 CLICGVLVTT RRRKKEGEYN VQQQCPGYYQ SHLDLEDLQ
```

TABLE 19A

Serine/Threonine O-glycosylation Pattern Predicted for the Amino Terminal End of the CA125 Molecule
(SEQ ID NO: 149)

Length: 1799                                                          SEQ ID NO: 149
RTDGIMEHITKIPNEAAHROTIRPVIMPOTSTSPASPKGLMTGOTKRMETTTTALKTTTTALKTTSRATLTTSVYTPTLG      80

TLTPLNASRQMASTILTEMMITTPYVFPDVPETTSSLATSLGAETSTALPRTTPSVLNRESETTASLVSRSGAERSPVIQ     160

TABLE 19A-continued

Serine/Threonine O-glycosylation Pattern Predicted for the
Amino Terminal End of the CA125 Molecule
(SEQ ID NO: 149)

```
TLDVSSSEPDTTASWVIHPARTIPTVSKTTPNFFHSELDTVSSTATSHGADVSSAIPTNISPSELDALTPLVTISGTDTS    240

TTFPTLTKSPHETETRTTWLTHPABTSSTIPRTIPNFSHHESDATPSIATSPGABTSSAIPIMTVSPGAEDLVTSQVTSS    320

GTDRNMTIPTLTLSPGEPKTIASLVTHPEAQTSSAIPTSTISPAVSRLVTSMVTSLAAKTSTTNRALTNSPGEPATTVSL    400

VTHPAQTSPTVPWTTSIFFHSKSDTTPSMTTSHGAESSSAVPTPTVSTEVPGVVTPLVTSSRAVISTTIPILTLSPGEPE    480

TTPSMATSHGEMASSAIPTPTVSPOVPGVVTSLVTSSRAVTSTTIPILTFSLGEPETTPSMATSHOTEAGSAVPTVLPEV    560

POMVTSLVASSRAVTSTTLPTLTLSPGEPETTPSMATSHGARASSTVPTVSPEVPOVVTSLVTSSSGVNSTSIPTLILSP    640

GELETTPSMATSHGAEASSAVPTPTVSPOVSGVVTPLVTSSRAVTSTTIPILTLSSSEPETTPSMATSHGVEASSAVLTV    720

SPEVPGMVTSLVTSSRAVTSTTIPTLTISSDEPETTTSLVTHSRAKMISAIPTLAVSPTVQGLVTSLVTBSGSETSAFSN    800

LTVASSQPETIDSWVAHPOTRASSVVPTLTVSTGEPFTNISLVTHPABSSSTLPRTTSRFSHSELDTMPSTVTSPEAESS    880

SAISTTISPGIPGVLTSLVTSSGRDISATFPTVPESPHESEATASWVTHPAVTSTTVPRTTPNYSHSEPDTTPSIATSPG    960

AEATSDFPTITVSPDVPDMVTSQVTSSGTDTSITIPTLTLSSGEPETTTSFITYSETHTSSAIPTLPVSPGASKMLTSLV   1040

ISSGTDSTTTFPTLTETPYEPETTAIQLIHPAETNTMVPRTTPKFSHSKSDTTLPVAITSPGPEASSAVSTTTISPDMSD   1120

LVTSLVPSSGTDTSTTFPTLSETPYEPETTATWLTHPAETSTTVSGTIPNFSHRGSDTAPSMVTSPGVDTRSGVPTTTIP   1200

PSIPOVVTSQVTSSATDTSTAIPTLTPSPGEPETTASSATHPOTOTOFTVPIRTVPSSEPDTMASWVTHPPOTSTPVSRT   1280

TSSFSHSSPDATPVMATSPRTEASSAVLTTISPGAPEMVTSQITSSGAATSTTYPTLTHSPOMPETTALLSTHPRTETSK   1360

TFPASTVFPQVSETTASLTIRPGAETSTALPTQTTSSLFTLLVTGTSRVDLSPTASPOVSARTAPLSTHPOTETSTMIPT   1440

STLSLOLLETTOLLATSSSAETSTSTLTLTVSPAVSGLSSASITTDKPQTVTSWNTETSPSVTSVGPPEFSRTVTOTTMT   1520

LIPSEMPTPPKTSHGEGVSPTTILRTTMVEATNLATTGSSPTVAKTTTTFNTLAGSLFTPLTTPGMSTLASESVTSRTSY   1600

NURSWISTTSSYNRRYWTPATSTPVTSTFSPGISTSSIPSSTAATVPFMVPFTLNFTITNLQYEEDMRHPOSREBNATER   1680

ELQGLLKPLFRNSSLEYLYSOCRLASLRPEKDSSAMAVDAICTIMPDPEDLGLDRERLYWELSNLTNGIQELGPYTLDRN   1760

SLYVNGFTHRSSMPTTSTPOTSTVDVOTSGTPSSSPSPT
```

TABLE 19B

Serine/Threonine O-glycosylation Pattern Predicted for the
Amino Terminal End of the CA125 Molecule

```
.....................T........TSTS.................TTT....TTTT...TT.....TT...T....    80
................................ST....TT............................................   160
.....S.....T...........T.S.............T.........S..........S...........S.T..S         240
T...T.T................TSS....T........S..T.S..TS......S.....T..........T...TS.        320
...........T.S.....T..S........TSS...TST..............T......STT....T.S.....TT.S.      400
.T....TS.T...T........S..T...TTS....SSS...T.T.ST..................T.....T.S.....       480
TT.S..T......SS...T.T.S...........S......T...........T.S..TS......S...T.....          560
.................T.....T.S.....TT.S..TS.....SST..T.S...........TS.S....T.........      640
.....T.S..T......SS...T.T.S...S.........S.....T.....T.SSS....T.S..TS......S.....       720
S...........S.....STT..T.T.SS.....TT.........S...................T...........          800
....S.................SS.....T.............T....SSS....T.............ST.T......S       880
S...TT.S..................S.....T........S..T....T....TSTT...TT...S.S....T.S..TS..    960
...TS.....T.........T...TS..........T.T.SS.....T....T.....T.S...T................     1040
.S..T.STTT..T.T.T...................T....TT.......S.........S.....SS....TT.......     1120
.......S..T..STT..T.S.T.....TT....T.....ST....................TS.......S....TT..      1200
.S......T...TS..T.TST...T.T.S.....TT.SS.T..............T..SS...T..S..T....TST..S.T     1280
TSS.S.SS...T....TS..T..SS....T.S.......T...TS....TSTT....T.S..........ST...T..S.       1360
....ST.....S.TT...T........ST...T.TT.S................T.S...S.......ST...T..ST...T    1440
ST............T..S..TSTS....T.....S..S..S..T....T.TS..T..S.S.TS......S.........T      1520
...S...T....S.......T...........TT.SS.T....................T...ST..S..........        1600
..................TST..TST.S...STSS..SST...........................                    1680
....................................................................                  1760
...............TTST...ST....TS.T.SSS.S.T
```

TABLE 20

Nucleotide and Amino Acid Sequences of Recombinant CA125 Repeat Showing Peptides
(Underlined 1-4) which are Antigenically Matched for Immune Stimulation of
Patients with the HLA-2 Histocompatibility Subtype
CA 125 Recombinant Nucleotide and Amino Acid Sequences
(SEQ ID NO: 151 and SEQ ID NO: 152, respectively)
CA 125 Recombinant Nucleotide (Anti-Sense Strand) Sequence (SEQ ID NO: 153)
Peptide 1 (SEQ ID NO: 154); Peptide 2 (SEQ ID NO: 155);
Peptide 3 (SEQ ID NO: 156) and Peptide 4 (SEQ ID NO: 157)

```
        ATGAGAGGATCGCATCACCATCACCATCACGGATCCATGGGCCACACAGAGCCTGGCCCT
  1     ---------+---------+---------+---------+---------+---------+    60
        TACTCTCCTAGCGTAGTGGTAGTGGTAGTGCCTAGGTACCCGGTGTGTCTCGGACCGGGA

M   R   G   S   H   H   H   H   H   H   G   S   M   G   H   T   E   P   G   P   -
                                                                            ↑
        CTCCTGATACCATTCACTTTCAACTTTACCATCACCAACCTGCATTATGAGGAAAACATG
  61    ---------+---------+---------+---------+---------+---------+   120
        GAGGACTATGGTAAGTGAAAGTTGAAATGGTAGTGGTTGGACGTAATACTCCTTTTGTAC

L   L   I   P   F   T   F   N   F   T   I   T   N   L   H   Y   E   E   N   M   -

CAACACCCTGGTTCCAGGAAGTTCAACACCACGGAGAGGGTTCTGCAGGGTCTGCTCAAG
 121    ---------+---------+---------+---------+---------+---------+   180
        GTTGTGGGACCAAGGTCCTTCAAGTTGTGGTGCCTCTCCCAAGACGTCCCAGACGAGTTC
                                                    3
        Q   H   P   G   S   R   K   F   N   T   T   E   R   V   L   Q   G   L   L   K   -

CCCTTGTTCAAGAACACCAGTGTTGGCCCTCTGTACTCTGGCTGCAGACTGACCTTGCTC
 181    ---------+---------+---------+---------+---------+---------+   240
        GGGAACAAGTTCTTGTGGTCACAACCGGGAGACATGAGACCGACGTCTGACTGGAACGAG

P   L   F   K   N   T   S   V   G   P   L   Y   S   G   C   R   L   T   L   L   -

AGACCTGAGAAGCATGAGGCAGCCACTGGAGTGGACACCATCTGTACCCACCGCGTTGAT
 241    ---------+---------+---------+---------+---------+---------+   300
        TCTGGACTCTTCGTACTCCGTCGGTGACCTCACCTGTGGTAGACATGGGTGGCGCAACTA

R   P   E   K   H   E   A   A   T   G   V   D   T   I   C   T   H   R   V   D   -

CCCATCGGACCTGGACTGGACAGAGAGCGGCTATACTGGGAGCTGAGCCAGCTGACCAAC
 301    ---------+---------+---------+---------+---------+---------+   360
        GGGTAGCCTGGACCTGACCTGTCTCTCGCCGATATGACCCTCGACTCGGTCGACTGGTTG
                                        1                       4
        P   I   G   P   G   L   D   R   E   R   L   Y   W   E   L   S   Q   L   T   N   -

AGCATCACAGAGCTGGGACCCTACACCCTGGACAGGGACAGTCTCTATGTCAATGGCTTC
 361    ---------+---------+---------+---------+---------+---------+   420
        TCGTAGTGTCTCGACCCTGGGATGTGGGACCTGTCCCTGTCAGAGATACAGTTACCGAAG
                                2
        S   I   T   E   L   G   P   Y   T   L   D   R   D   S   L   Y   V   N   G   F   -

AACCCTCGGAGCTCTGTGCCAACCACCAGCACTCCTGGGACCTCCACAGTGCACCTGGCA
 421    ---------+---------+---------+---------+---------+---------+   480
        TTGGGAGCCTCGAGACACGGTTGGTGGTCGTGAGGACCCTGGAGGTGTCACGTGGACCGT

N   P   R   S   S   V   P   T   T   S   T   P   G   T   S   T   V   H   L   A   -

ACCTCTGGGACTCCATCCTCCCTGCCT
 481    ---------+---------+-------    507
        TGGAGACCCTGAGGTAGGAGGGACGGA

T   S   G   T   P   S   S   L   P   -
```

(SEQ ID NO: 154)
Peptide 1                R L Y W E L S Q L (SEQ ID NO: 155)
Peptide 2                T L D R D S L Y V (SEQ ID NO: 156)
Peptide 3                V L Q G L L K P L (SEQ ID NO: 157)
Peptide 4                Q L T N S I T E L

TABLE 21

CA125 Protein Sequence
(SEQ ID NO: 162)

Amino Terminal Domain

```
   1 MEHITKIPNE AAHRGTIRPV KGPQTSTSPA SPKGLHTGGT KRMETTTTAL
  51 KTTTTALKTT SRATLTTSVY TPTLGTLTPL NASRQMASTI LTEMMITTPY
 101 VFPDVPETTS SLATSLGAET STALPRTTPS VLNRESETTA SLVSRSGAER
 151 SPVIQTLDVS SSEPDTTASW VIHPAETIPT VSKTTPNFFH SELDTVSSTA
 201 TSHGADVSSA IPTNISPSEL DALTPLVTIS GTDTSTTFPT LTKSPHETET
 251 RTTWLTHPAE TSSTIPRTIP NFSHHESDAT PSIATSPGAE TSSAIPIMTV
 301 SPGAEDLVTS QVTSSGTDRN MTIPTLTLSP GEPKTIASLV THPEAQTSSA
 351 IPTSTISPAV SRLVTSMVTS LAAKTSTTNR ALTNSPGEPA TTVSLVTHPA
 401 QTSPTVPWTT SIFFHSKSDT TPSMTTSHGA ESSSAVPTPT VSTEVPGVVT
 451 PLVTSSRAVI STTIPILTLS PGEPETTPSM ATSHGEEASS AIPTPTVSPG
 501 VPGVVTSLVT SSRAVTSTTI PILTFSLGEP ETTPSMATSH GTEAGSAVPT
 551 VLPEVPGMVT SLVASSRAVT STTLPTLTLS PGEPETTPSM ATSHGAEASS
 601 TVPTVSPEVP GVVTSLVTSS SGVNSTSIPT LILSPGELET TPSMATSHGA
 651 EASSAVPTPT VSPGVSGVVT PLVTSSRAVT STTIPILTLS SSEPETTPSM
 701 ATSHGVEASS AVLTVSPEVP GMVTSLVTSS RAVTSTTIPT LTISSDEPET
 751 TTSLVTHSEA KMISAIPTLA VSPTVQGLVT SLVTSSGSET SAFSNLTVAS
 801 SQPETIDSWV AHPGTEASSV VPTLTVSTGE PFTNISLVTH PAESSSTLPR
 851 TTSRFSHSEL DTMPSTVTSP EAESSSAIST TISPGIPGVL TSLVTSSGRD
 901 ISATFPTVPE SPHESEATAS WVTHPAVTST TVPRTTPNYS HSEPDTTPSI
 951 ATSPGAEATS DFPTITVSPD VPDMVTSQVT SSGTDTSITI PTLTLSSGEP
1001 ETTTSFITYS ETHTSSAIPT LPVSPGASKM LTSLVISSGT DSTTTFPTLT
1051 ETPYEPETTA IQLIHPAETN TMVPRTTPKF SHSKSDTTLP VAITSPGPEA
1101 SSAVSTTTIS PDMSDLVTSL VPSSGTDTST TFPTLSETPY EPETTATWLT
1151 HPAETSTTVS GTIPNFSHRG SDTAPSMVTS PGVDTRSGVP TTTIPPSIPG
1201 VVTSQVTSSA TDTSTAIPTL TPSPGEPETT ASSATHPGTQ TGFTVPIRTV
1251 PSSEPDTMAS WVTHPPQTST PVSRTTSSFS HSSPDATPVM ATSPRTEASS
1301 AVLTTISPGA PEMVTSQITS SGAATSTTVP TLTHSPGMPE TTALLSTHPR
1351 TETSKTFPAS TVFPQVSETT ASLTIRPGAE TSTALPTQTT SSLFTLLVTG
1401 TSRVDLSPTA SPGVSAKTAP LSTHPGTETS TMIPTSTLSL GLLETTGLLA
1451 TSSSAETSTS TLTLTVSPAV SGLSSASITT DKPQTVTSWN TETSPSVTSV
1501 GPPEFSRTVT GTTMTLIPSE MPTPPKTSHG EGVSPTTILR TTMVEATNLA
1551 TTGSSPTVAK TTTTFNTLAG SLFTPLTTPG MSTLASESVT SRTSYNHRSW
1601 ISTTSSYNRR YWTPATSTPV TSTFSPGIST SSIPSSTA
```

Repeat Domain

```
                                                  AT VPFMVPFTLN
1651 FTITNLQYEE DMRHPGSRKF NATERELQGL LKPLFRNSSL EYLYSG<u>CRLA</u>
1701 <u>SLRPEKDSSA MAVDAIC</u>THR PDPEDLGLDR ERLYWELSNL TNGIQELGPY
1751 TLDRNSLYVN GFTHRSSMPT TSTPGTSTVD VGTSGTPSSS PSPTAAGPLL
```

TABLE 21-continued

CA125 Protein Sequence
(SEQ ID NO: 162)

```
1801 MPFTLNFTIT NLQYEEDMRR TGSRKFNTME SVLQGLLKPL FKNTSVGPLY

1851 SGCRLTLLRP EKDGAATGVD AICTHRLDPK SPGLNREQLY WELSKLTNDI

1901 EELGPYTLDR NSLYVNGFTH QSSVSTTSTP GTSTVDLRTS GTPSSLSSPT

1951 IMAAGPLLVP FTLNFTITNL QYGEDMGHPG SRKFNTTERV LQGLLGPIFK

2001 NTSVGPLYSG CRLTSLRSEK DGAATGVDAI CIHHLDPKSP GLNRERLYWE

2051 LSQLTNGIKE LGPYTLDRNS LYVNGFTHRT SVPTSSTPGT STVDLGTSGT

2101 PFSLPSPATA GPLLVLFTLN FTITNLKYEE DMHRPGSRKF NTTERVLQTL

2151 LGPMFKNTSV GLLYSGCRLT LLRSEKDGAA TGVDAICTHR LDPKSPGLDR

2201 EQLYWELSQL TNGIKELGPY TLDRNSLYVN GFTHWIPVPT SSTPGTSTVD

2251 LGSGTPSSLP SPTAAGPLLV PFTLNFTITN LQYEEDMHHP GSRKFNTTER

2301 VLQGLLGPMF KNTSVGLLYS GCRLTLLRSE KDGAATGVDA ICTHRLDPKS

2351 PGVDREQLYW ELSQLTNGIK ELGPYTLDRN SLYVNGFTHQ TSAPNTSTPG

2401 TSTVDLGTSG TPSSLPSPTS AGPLLVPFTL NFTITNLQYE EDMRHPGSRK

2451 FNTTERVLQG LLKPLFKNTS VGPLYSGCRL TLLRSEKDGA ATGVDAICTH

2501 RLDPKSPGVD REQLYWELSQ LTNGIKELGP YTLDRNSLYV NGFTHQTSAP

2551 NTSTPGTSTV DLGTSGTPSS LPSPTSAGPL LVPFTLNFTI TNLQYEEDMH

2601 HPGSRKFNTT ERVLQGLLGP MFKNTSVGLL YSGCRLTLLR PEKNGAATGM

2651 DAICSHRLDP KSPGLNREQL YWELSQLTHG IKELGPYTLD RNSLYVNGFT

2701 HRSSVAPTST PGTSTVDLGT SGTPSSLPSP TTAVPLLVPF TLNFTITNLQ

2751 YGEDMRHPGS RKFNTTERVL QGLLGPLFKN SSVGPLYSGC RLISLRSEKD

2801 GAATGVDAIC THHLNPQSPG LDREQLYWQL SQMTNGIKEL GPYTLDRNSL

2851 YVNGFTHRSS GLTTSTPWTS TVDLGTSGTP SPVPSPTTAG PLLVPFTLNF

2901 TITNLQYEED MHRPGSRKFN ATERVLQGLL SPIFKNSSVG PLYSGCRLTS

2951 LRPEKDGAAT GMDAVCLYHP NPKRPGLDRE QLYWELSQLT HNITELGPYS

3001 LDRDSLYVNG FTHQNSVPTT STPGTSTVYW ATTGTPSSFP GHTEPGPLLI

3051 PFTNFTITN LHYEENMQHP GSRKFNTTER VLQGLLKPLF KNTSVGPLYS

3101 GCRLTSLRPE KDGAATGMDA VCLYHPNPKR PGLDREQLYC ELSQLTHNIT

3151 ELGPYSLDRD SLYVNGFTHQ NSVPTTSTPG TSTVYWATTG TPSSFPGHTE

3201 PGPLLIPFTF NFTITNLHYE ENMQHPGSRK FNTTERVLQG LLKPLFKNTS

3251 VGPLYSGCRL TLLRPEKHEA ATGVDTICTH RVDPIGPGLD RERLYWELSQ

3301 LTNSITELGP YTLDRDSLYV NGFNPRSSVP TTSTPGTSTV HLATSGTPSS

3351 LPGHTAPVPL LIPFTLNFTI TNLHYEENMQ HPGSRKFNTT ERVLQGLLKP

3401 LFKNTSVGPL YSGCRLTLLR PEKHEAATGV DTICTHRVDP IGPGLDREXL

3451 YWELSXLTXX IXELGPYXLD RXSLYVNGFX XXXXXXXTST PGTSXVXLXT

3501 SGTPXXXPXX TSAGPLLVPF TLNFTITNLQ YEEDMHHPGS RKFNTTERVL

3551 QGLLGPMFKN TSVGLLYSGC RLTLLRPEKN GAATGMDAIC SHRLDPKSPG

3601 LDREQLYWEL SQLTHGIKEL GPYTLDRNSL YVNGFTHRSS VAPTSTPGTS

3651 TVDLGTSGTP SSLPSPTTAV PLLVPFTLNF TITNLQYGED MRHPGSRKFN

3701 TTERVLQGLL GPLFKNSSVG PLYSGCRLIS LRSEKDGAAT GVDAICTHHL
```

TABLE 21-continued

CA125 Protein Sequence
(SEQ ID NO: 162)

```
3751  NPQSPGLDRE QLYWQLSQMT NGIKELGPYT LDRNSLYVNG FTHRSSGLTT
3801  STPWTSTVDL GTSGTPSPVP SPTTAGPLLV PFTLNFTITN LQYEEDMHRP
3851  GSRKFNATER VLQGLLSPIF KNSSVGPLYS GCRLTSLRPE KDGAATGMDA
3901  VCLYHPNPKR PGLDREQLyW ELSQLTHNIT ELGPYSLDRD SLYVNGFTHQ
3951  SSMTTTRTPD TSTMHLATSR TPASLSGPTT ASPLLVLFTI NCTITNLQYE
4001  EDMRRTGSRK FNTMESVLQG LLKPLFKNTS VGPLYSGCRL TLLRPKKDGA
4051  ATGVDAICTH RLDPKSPGLN REQLYWELSK LTNDIEELGP YTLDRNSLYV
4101  NGFTHQSSVS TTSTPGTSTV DLRTSGTPSS LSSPTIMXXX PLLXPFTLNF
4151  TITNLXYEEX MXXPGSRKFN TTERVLQGLL RPLFKNTSVS SLYSGCRLTL
4201  LRPEKDGAAT RVDAACTYRP DPKSPGLDRE QLYWELSQLT HSITELGPYT
4251  LDRVSLYVNG FNPRSSVPTT STPGTSTVHL ATSGTPSSLP GHTXX XPLL
4301  XPFTLNFTIT NLXYEEXMXX PGSRKFNTTE RVLQGLLKPL FRNSSLEYLY
4351  SGCRLASLRP EKDSSAMAVD AICTHRPDPE DLGLDRERLY WELSNLTNGI
4401  QELGPYTLDR NSLYVNGFTH RSSFLTTSTP WTSTVDLGTS GTPSPVPSPT
4451  TAGPLLVPFT LNFTITNLQY EEDMHRPGSR RFNTTERVLQ GLLTPLFKNT
4501  SVGPLYSGCR LTLLRPEKQE AATGVDTICT HRVDPIGPGL DRERLYWELS
4551  QLTNSITELG PYTLDRDSLY VNGFNPWSSV PTTSTPGTST VHLATSGTPS
4601  SLPGHTAPVP LLIPFTLNFT ITDLHYEENM QHPGSRKFNT TERVLQGLLK
4651  PLFKSTSVGP LYSGCRLTLL RPEKHGAATG VDAICTLRLD PTGPGLDRER
4701  LYWELSQLTN SVTELGPYTL DRDSLYVNGF THRSSVPTTS IPGTSAVHLE
4751  TSGTPASLPG HTAPGPLLVP FTLNFTITNL QYEEDMRHPG SRKFSTTERV
4801  LQGLLKPLFK NTSVSSLYSG CRLTLLRPEK DGAATRVDAV CTHRPDPKSP
4851  GLDRERLYWK LSQLTHGITE LGPYTLDRHS LYVNGFTHQS SMTTTRTPDT
4901  STMHLATSRT PASLSGPTTA SPLLVLFTIN FTITNQRYEE NMHHPGSRKF
4951  NTTERVLQGL LRPVFKNTSV GPLYSGCRLT LLRPKKDGAA TKVDAICTYR
5001  PDPKSPGLDR EQLYWELSQL THSITELGPY TQDRDSLYVN GFTHRSSVPT
5051  TSIPGTSAVH LETSGTPASL PGHTAPGPLL VPFTLNFTIT NLQYEEDMRH
5101  PGSRKFNTTE RVLQGLLKPL FKSTSVGPLY SGCRLTLLRP EKRGAATGVD
5151  TICTHRLDPL NPGLDREQLY WELSKLTRGI IELGPYLLDR GSLYVNGFTH
5201  RTSVPTTSTP GTSTVDLGTS GTPFSLPSPA XXXPLLXPFT LNFTITNLXY
5201  EEXMXXPGSR KFNTTERVLQ TLLGPMFKNT SVGLLYSGCR LTLLRSEKDG
5251  AATGVDAICT HRLDPKSPGV DREQLYWELS QLTNGIKELG PYTLDRNSLY
5301  VNGFTHWIPV PTSSTPGTST VDLGSGTPSL PSSPTTAGPL LVPFTLNFTI
5351  TNLKYEEDMH CPGSRKFNTT ERVLQSLLGP MFKNTSVGPL YSGCRLTLLR
5401  SEKDGAATGV DAICTHRLDP KSPGVDREQL YWELSQLTNG IKELGPYTLD
5451  RNSLYVNGFT HQTSAPNTST PGTSTVDLGT SGTPSSLPSP TXXXPLLXPF
5501  TLNFTITNLX YEEXMXXPGS RKFNTTERVL QGLLXPXFKX TSVGXLYSGC
5551  RLTLLRXEKX XAATXVDXXC XXXXDPXXPG LDREXLYWEL SXLTXXIXEL
```

TABLE 21-continued

CA125 Protein Sequence
(SEQ ID NO: 162)

```
5601  GPYXLDRXSL YVNGFTHWIP VPTSSTPGTS TVDLGSGTPS SLPSPTTAGP

5651  LLVPFTLNFT ITNLKYEEDM HCPGSRKFNT TERVLQSLLG PMFKNTSVGP

5701  LYSGCRLTSL RSEKDGAATG VDAICTHRVD PKSPGVDREQ LYWELSQLTN

5751  GIKELGPYTL DRNSLYVNGF THQTSAPNTS TPGTSTVDLG TSGTPSSLPS

5801  PTSAGPLLVP FTLNFTITNL QYEEDMHHPG SRKFNTTERV LQGLLGPMFK

5851  NTSVGLLYSG CRLTLLRPEK NGAATGMDAI CTHRLDPKSP GLDREXLYWE

5901  LSXLTXXIXE LGPYXLDRXS LYVNGFXXXX XXXXTSTPGT SXVXLXTSGT

5951  PXXXPXXTXX XPLLXPFTLN FTITNLXYEE XMXXPGSRKF NTTERVLQGL

6001  LKPLFRNSSL EYLYSGCRLA SLRPEKDSSA MAVDAICTHR PDPEDLGLDR

6051  ERLYWELSNL TNGIQELGPY TLDRNSLYVN GFTHRSSMPT TSTPGTSTVD

6101  VGTSGTPSSS PSPTTAGPLL IPFTLNFTIT NLQYGEDMGH PGSRKFNTTE

6151  RVLQGLLGPI FKNTSVGPLY SGCRLTSLRS EKDGAATGVD AICIHHLDPK

6201  SPGLNRERLY WELSQLTNGI KELGPYTLDR NSLYVNGFTH RTSVPTTSTP

6251  GTSTVDLGTS GTPFSLPSPA TAGPLLVLFT LNFTITNLKY EEDMHRPGSR

6301  KFNTTERVLQ TLLGPMFKNT SVGLLYSGCR LTLLRSEKDG AATGVDAICT

6351  HRLDPKSPGL DREXLYWELS XLTXXIXELG PYXLDRXSLY VNGFXXXXXX

6401  XXTSTPGTSX VXLXTSGTPX XXPXXTXXXP LLXPFTLNFT ITNLXYEEXM

6451  XXPGSRKFNT TERVLQGLLR PVFKNTSVGP LYSGCRLTLL RPKKDGAATK

6501  VDAICTYRPD PKSPGLDREQ LYWELSQLTH SITELGPYTQ DRXSLYVNGF

6551  THRSSVPTTS IPGTSAVHLE TTGTPSSFPG HTEPGPLLIP FTFNFTITNL

6601  RYEENMQHPG SRKFNTTERV LQGLLTPLFK NTSVGPLYSG CRLTLLRPEK

6651  QEAATGVDTI CTHRVDPIGP GLDRERLYWE LSQLTNSITE LGPYTLDRDS

6701  LYVDGFNPWS SVPTTSTPGT STVHLATSGT PSPLPGHTAP VPLLIPFTLN

6751  FTITDLHYEE NMQHPGSRKF NTTERVLQGL LKPLFKSTSV GPLYSGCRLT

6801  LLRPEKHGAA TGVDAICTLR LDPTGPGLDR ERLYWELSQL TNSITELGPY

6851  TLDRDSLYVN GFNPWSSVPT TSTPGTSTVH LATSGTPSSL PGHTTAGPLL

6901  VPFTLNFTIT NLKYEEDMHC PGSRKFNTTE RVLQSLHGPM FKNTSVGPLY

6951  SGCRLTLLRS EKDGAATGVD AICTHRLDPK SPGLDREXLY WELSXLTXXI

7001  XELGPYXLDR XSLYVNGFXX XXXXXXTSTP GTSXVXLXTS GTPXXXPXXT

7051  XXXPLLXPFT LNFTITNLXY EEXMXXPGSR KFNTTERVLQ GLLXPXFKXT

7101  SVGXLYSGCR LTLLRXEKXX AATXVDXXCX XXXDPXXPGL DREXLYWELS

7151  XLTNSITELG PYTLDRDSLY VNGFTHRSSM PTTSIPGTSA VHLETSGTPA

7201  SLPGHTAPGP LLVPFTLNFT ITNLQYEEDM RHPGSRKFNT TERVLQGLLK

7251  PLFKSTSVGP LYSGCRLTLL RPEKRGAATG VDTICTHRLD PLNPGLDREX

7301  LYWELSXLTX XIXELGPYXL DRXSLYVNGF XXXXXXXXTS TPGTSXVXLX

7351  TSGTPXXXPX XTXXXPLLXP FTLNFTITNL XYEEXMXXPG SRKFNTTERV

7401  LQGLLXPXFK XTSVGXLYSG CRLTLLRXEK XXAATXVDXX CXXXXDPXXP

7451  GLDREXLYWE LSXLTXXIXE LGPYXLDRXS LYVNGFHPRS SVPTTSTPGT

7501  STVHLATSGT PSSLPGHTAP VPLLIPFTLN FTITNLHYEE NMQHPGSRKF
```

TABLE 21-continued

CA125 Protein Sequence
(SEQ ID NO: 162)

```
7551  NTTERVLQGL LGPMFKNTSV GLLYSGCRLT LLRPEKNGAA TGMDAICSHR

7601  LDPKSPGLDR EXLYWELSXL TXXIXELGPY XLDRXSLYVN GFXXXXXXXX

7651  TSTPGTSXVX LXTSGTPXXX PXXTXXXPLL XPFTLNFTIT NLXYEEXMXX

7701  PGSRKFNTTE RVLQGLLXPX FKXTSVGXLY SGCRLTLLRX EKXXAATXVD

7751  XXCXXXXDPX XPGLDREXLY WELSXLTXXI XELGPYXLDR XSLYVNGFTH

7801  QNSVPTTSTP GTSTVYWATT GTPSSFPGHT EPGPLLIPFT FNFTITNLHY

7851  EENMQHPGSR KFNTTERVLQ GLLTPLFKNT SVGPLYSGCR LTLLRPEKQE

7901  AATGVDTICT HRVDPIGPGL DREXLYWELS XLTXXIXELG PYXLDRXSLY

7951  VNGFXXXXXX XXTSTPGTSX VXLXTSGTPX XXPXXTXXXP LLXPFTLNFT

8001  ITNLXYEEXM XXPGSRKFNT TERVLQGLLX PXFKXTSVGX LYSGCRLTLL

8051  RXEKXXAATX VDXXCXXXXD PXXPGLDREX LYWELSXLTX XIXELGPYXL

8101  DRXSLYVNGF THRSSVPTTS SPGTSTVHLA TSGTPSSLPG HTAPVPLLIP

8151  FTLNFTITNL HYEENMQHPG SRKFNTTERV LQGLLKPLFK STSVGPLYSG

8201  CRLTLLRPEK HGAATGVDAI CTLRLDPTGP GLDREXLYWE LSXLTXXIXE

8251  LGPYXLDRXS LYVNGFXXXX XXXXTSTPGT SXVXLXTSGT PXXXPXXTXX

8301  XPLLXPFTLN FTITNLXYEE XMXXPGSRKF NTTERVLQGL LXPXFKXTSV

8351  GXLYSGCRLT LLRXEKXXAA TXVDXXCXXX XDPXXPGLDR EXLYWELSXL

8401  TXXIXELGPY XLDRXSLYVN GFTHRTSVPT TSTPGTSTVH LATSGTPSSL

8451  PGHTAPVPLL IPFTLNFTIT NLQYEEDMHR PGSRKFNTTE RVLQGLLSPI

8501  FKNSSVGPLY SGCRLTSLRP EKDGAATGMD AVCLYHPNPK RPGLDREQLY

8551  CELSQLTHNI TELGPYSLDR DSLYVNGFTH QNSVPTTSTP GTSTVYWATT

8601  GTPSSFPGHT XXXPLLXPFT LNFTITNLXY EEXMXXPGSR KFNTTERVLQ

8651  GLLXPXFKXT SVGXLYSGCR LTLLRXEKXX AATXVDXXCX XXXDPXXPGL

8701  DREXLYWELS XLTXXIXELG PYXLDRXSLY VNGFTHWSSG LTTSTPWTST

8751  VDLGTSGTPS PVPSPTTAGP LLVPFTLNFT ITNLQYEEDM HRPGSRKFNA

8801  TERVLQGLLS PIFKNTSVGP LYSGCRLTLL RPEKQEAATG VDTICTHRVD

8851  PIGPGLDREX LYWELSXLTX XIXELGPYXL DRXSLYVNGF XXXXXXXXTS

8901  TPGTSXVXLX TSGTPXXXPX XTXXXPLLXP FTLNFTITNL XYEEXMXXPG

8951  SRKFNTTERV LQGLLXPXFK XTSVGXLYSG CRLTLLRXEK XXAATXVDXX

9001  CXXXXDPXXP GLDREXLYWE LSXLTXXIXE LGPYXLDRXS LYVNGFTHRS

9051  FGLTTSTPWT STVDLGTSGT PSPVPSPTTA GPLLVPFTLN FTITNLQYEE

9101  DMHRPGSRKF NTTERVLQGL LTPLFRNTSV SSLYSGCRLT LLRPEKDGAA

9151  TRVDAVCTHR PDPKSPGLDR EXLYWELSXL TXXIXELGPY XLDRXSLYVN

9201  GFXXXXXXXX TSTPGTSXVX LXTSGTPXXX PXXTXXXPLL XPFTLNFTIT

9251  NLXYEEXMXX PGSRKFNTTE RVLQGLLXPX FKXTSVGXLY SGCRLTLLRX

9301  EKXXAATXVD XXCXXXXDPX XPGLDREXLY WELSXLTXXI XELGPYXLDR

9351  XSLYVNGFTH WIPVPTSSTP GTSTVDLGSG TPSSLPSPTT AGPLLVPFTL

9401  NFTITNLQYG EDMGHPGSRK FNTTERVLQG LLGPIFKNTS VGPLYSGCRL
```

TABLE 21-continued

CA125 Protein Sequence
(SEQ ID NO: 162)

| | |
|---|---|
| 9451 | TSLRSEKDGA ATGVDAICIH HLDPKSPGLD REXLYWELSX LTXXIXELGP |
| 9501 | YXLDRXSLYV NGFXXXXXXX XTSTPGTSXV XLXTSGTPXX XPXXTXXXPL |
| 9551 | LXPFTLNFTI TNLXYEEXMX XPGSRKFNTT ERVLQGLLXP XFKXTSVGXL |
| 9601 | YSGCRLTLLR XEKXXAATXV DXXCXXXXDP XXPGLDREXL YWELSXLTXX |
| 9651 | IXELGPYXLD RXSLYVNGFT HQTFAPNTST PGTSTVDLGT SGTPSSLPSP |
| 9701 | TSAGPLLVPF TLNFTITNLQ YEEDMHHPGS RKFNTTERVL QGLLGPMFKN |
| 9751 | TSVGLLYSGC RLTLLRPEKN GAATRVDAVC THRPDPKSPG LDREXLYWEL |
| 9801 | SXLTXXIXEL GPYXLDRXSL YVNGFXXXXX XXXTSTPGTS XVXLXTSGTP |
| 9851 | XXXPXXTAPV PLLIPFTLNF TITNLHYEEN MQHPGSRKFN TTERVLQGLL |
| 9901 | RPLFKSTSVG PLYSGCRLTL LRPEKHGAAT GVDAICTLRL DPTGPGLDRE |
| 9951 | RLYWELSQLT NSVTELGPYT LDRDSLYVNG FTQRSSVPTT SIPGTSAVHL |
| 10001 | ETSGTPASLP GHTAPGPLLV PFTLNFTITN LQYEVDMRHP GSRKFNTTER |
| 10051 | VLQGLLKPLF KSTSVGPLYS GCRLTLLRPE KRGAATGVDT ICTHRLDPLN |
| 10101 | PGLDREQLYW ELSKLTRGII ELGPYLLDRG SLYVNGFTHR NFVPITSTPG |
| 10151 | TSTVHLGTSE TPSSLPRPIV PGPLLVPFTL NFTITNLQYE EAMRHPGSRK |
| 10201 | FNTTERVLQG LLRPLFKNTS IGPLYSSCRL TLLRPEKDKA ATRVDAICTH |
| 10251 | HPDPOSPGLN REQLYWELSQ LTHGITELGP YTLDRDSLYV DGFTHWSPIP |
| 10301 | TTSTPGTSIV NLGTSGIPPS LPETTXXXPL LXPFTLNFTI TNLXYEEXMX |
| 10351 | XPGSRKFNTT ERVLQGLLKP LFKSTSVGPL YSGCRLTLLR PEKDGVATRV |
| 10451 | DAICTHRPDP KIPGLDRQQL YWELSQLTHS ITELGPYTLD RDSLYVNGFT |
| 10501 | QRSSVPTTST PGTFTVQPET SETPSSLPGP TATGPVLLPF TLNFTITNLQ |
| 10551 | YEEDMHRPGS RKFNTTERVL QGLLMPLFKN TSVSSLYSGC RLTLLRPEKD |
| 10601 | GAATRVDAVC THRPDPKSPG LDRERLYWKL SQLTHGITEL GPYTLDRHSL |
| 10651 | YVNGFTHQSS MTTTRTPDTS TMHLATSRTP ASLSGPTTAS PLLVLFTINF |
| 10701 | TITNLRYEEN MHHPGSRKFN TTERVLQGLL RPVFKNTSVG PLYSGCRLTL |
| 10751 | LRPKKDGAAT KVDAICTYRP DPKSPGLDRE QLYWELSQLT HSITELGPYT |
| 10801 | QDRDSLYNVG FTQRSSVPTT SVPGTPTVDL GTSGTPVSKP GPSAASPLLV |
| 10851 | LFTLNGTITN LRYEENMQHP GSRKFNTTER VLQGLLRSLF KSTSVGPLYS |
| 10901 | GCRLTLLRPE KDGTATGVDA ICTHHPDPKS PRLDREQLYW ELSQLTHNIT |
| 10951 | ELGHYALDND SLFVNGFTHR SSVSTTSTPG TPTVYLGASK TPASIFGPSA |
| 11001 | ASHLLILFTL NFTITNLRYE ENMWPGSRKF NTTERVLQGL LRPLFKNTSV |
| 11051 | GPLYSGSRLT LLRPEKDGEA TGVDAICTHR PDPTGPGLDR EQLYLELSQL |
| 11101 | THSITELGPY TLDRDSLYVN GFTHRSSVPT TSTGVVSEEP FTLNFTINNL |
| 11151 | RYMADMGQPG SLKFNITDNV MKHLLSPLFQ RSSLGARYTG CRVIALRSVK |
| 11201 | NGAETRVDLL CTYLQPLSGP GLPIKQVFHE LSQQTHGITR LGPYSLDKDS |
| 11251 | LYLNGYNEPG LDEPPTTPKP ATTFLPPLSE ATTAMGYHLK TLTLNFTISN |
| 11301 | LQYSPDMGKG SATFNSTEGV LQHLLRPLFQ KSSMGPFYLG CQLISLRPEK |

TABLE 21-continued

CA125 Protein Sequence
(SEQ ID NO: 162)

```
11351  DGAATGVDTT CTYHPDPVGP GLDIQQLYWE LSQLTHGVTQ LGFYVLDRDS
11401  LFINGYAPQN LSIRGEYQIN FHIVNWNLSN PDPTSSEY
```

Carboxy Terminal Domain

```
                                            IT LLRDIQDKVT
11451  TLYKGSQLHD TFRFCLVTNL TMDSVLVTVK ALFSSNLDPS LVEQVFLDKT
11501  LNASFHWLGS TYQLVDIHVT EMESSVYQPT SSSSTQHFYL NFTITNLPYS
11551  QDKAQPGTTN YQRNKRNIED ALNQLFRNSS IKSYFSDCQV STFRSVPNRH
11601  HTGVDSLCNF SPLARRVDRV AIYEEFLRMT RNGTQLQNFT LDRSSVLVDG
11651  YSPNRNEPLT GNSDLPFWAV ILIGLAGLLG LITCLICGVL VTTRRRKKEG
11701  EYNVQQQCPG YYQSHLDLED LQ
```

TABLE 22

CA125 Repeat Nucleotide Sequence
(SEQ ID NO: 307)

```
  1  ACTGCTGGCC CTCTCCTGGT GCCATTCACC CTCAACTTCA CCATCACCAA
 51  CCTGCAGTAT GAGGAGGACA TGCATCGCCC TGGATCTAGG AAGTTCAACA
101  CCACAGAGAG GGTCCTGCAG GGTCTGCTTA GTCCCATATT CAAGAACACC
151  AGTGTTGGCC CTCTGTACTC TGGCTGCAGA CTGACCTCTC TCAGGTCTGA
201  GAAGGATGGA GCAGCCACTG GAGTGGATGC CATCTGCATC CATCATCTTG
251  ACCCCAAAAG CCCTGGACTC AACAGAGAGC GGCTGTACTG GGAGCTGAGC
301  CGACTGACCA ATGGCATCAA AGAGCTGGGC CCCTACACCC TGGACAGGAA
351  CAGTCTCTAT GTCAATGGTT TCACCCATCG GACCTCTGTG CCCACCACCA
401  GCACTCCTGG GACCTCCACA GTGGACCTTG GAACCTCAGG GACTCCATTC
451  TCCCTCCCAA GCCCCGCA
```

TABLE 23

CA125 Repeat Amino Acid Sequence
(SEQ ID NO: 308)

```
  1  TAGPLLVPFT LNFTITNLQY EEDMHRPGSR KFNTTERVLQ GLLSPIFKNT
 51  SVGPLYSGCR LTSLRSEKDG AATGVDAICI HHLDPKSPGL NRERLYWELS
101  RLTNGIKELG PYTLDRNSLY VNGFTHRTSV PTTSTPGTST VDLGTSGTPF
151  SLPSPA
```

TABLE 24

DNA Sequence of the CA125 Amino Terminal Extension
(SEQ ID NO: 309)

```
  1  AAGCGTTGCA CAATTCCCCC AACCTCCATA CATACGGCAG CTCTTCTAGA
 51  CACAGGTTTT CCCAGGTCAA ATGCGGGGAC CCAGCCATA TCTCCCACCC
101  TGAGAAATTT TGGAGTTTCA GGGAGCTCAG AAGCTCTGCA GAGGCCACCC
151  TCTCTGAGGG GATTCTTCTT AGACCTCCAT CCAGAGGCAA ATGTTGACCT
```

TABLE 24-continued

DNA Sequence of the CA125 Amino Terminal Extension
(SEQ ID NO: 309)

```
 201  GTCCATGCTG AAACCCTCAG GCCTTCCTGG GTCATCTTCT CCCACCCGCT
 251  CCTTGATGAC AGGGAGCAGG AGCACTAAAG CCACACCAGA AATGGATTCA
 301  GGACTGACAG GAGCCACCTT GTCACCTAAG ACATCTACAG GTGCAATCGT
 351  GGTGACAGAA CATACTCTGC CCTTTACTTC CCCAGATAAG ACCTTGGCCA
 401  GTCCTACATC TTCGGTTGTG GGAAGAACCA CCCAGTCTTT GGGGGTGATG
 451  TCCTCTGCTC TCCCTGAGTC AACCTCTAGA GGAATGACAC ACTCCGAGCA
 501  AAGAACCAGC CCATCGCTGA GTCCCCAGGT CAATGGAACT CCCTCTAGGA
 551  ACTACCCTGC TACAAGCATG GTTTCAGGAT TGAGTTCCCC AAGGACCAGG
 601  ACCAGTTCCA CAGAAGGAAA TTTTACCAAA GAAGCATCTA CATACACACT
 651  CACTGTAGAG ACCACAAGTG GCCCAGTCAC TGAGAAGTAC ACAGTCCCCA
 701  CTGAGACCTC AACAACTGAA GGTGACAGCA CAGAGACCCC CTGGGACACA
 751  AGATATATTC CTGTAAAAAT CACATCTCCA ATGAAAACAT TTGCAGATTC
 801  AACTGCATCC AAGGAAAATG CCCCAGTGTC TATGACTCCA GCTGAGACCA
 851  CAGTTACTGA CTCACATACT CCAGGAAGGA CAAACCCATC ATTTGGGACA
 901  CTTTATTCTT CCTTCCTTGA CCTATCACCT AAAGGGACCC CAAATTCCAG
 951  AGGTGAAACA AGCCTGGAAC TGATTCTATC AACCACTGGA TATCCCTTCT
1001  CCTCTCCTGA ACCTGGCTCT GCAGGACACA GCAGAATAAG TACCAGTGCG
1051  CCTTTGTCAT CATCTGCTTC AGTTCTCGAT AATAAAATAT CAGAGACCAG
1101  CATATTCTCA GGCCAGAGTC TCACCTCCCC TCTGTCTCCT GGGGTGCCCG
1151  AGGCCAGAGC CAGCACAATG CCCAACTCAG CTATCCCTTT TTCCATGACA
1201  CTAAGCAATG CAGAAACAAG TGCCGAAAGG GTCAGAAGCA CAATTTCCTC
1251  TCTGGGGACT CCATCAATAT CCACAAAGCA GACAGCAGAG ACTATCCTTA
1301  CCTTCCATGC CTTCGCTGAG ACCATGGATA TACCCAGCAC CCACATAGCC
1351  AAGACTTTGG CTTCAGAATG GTTGGGAAGT CCAGGTACCC TTGGTGGCAC
1401  CAGCACTTCA GCGCTGACAA CCACATCTCC ATCTACCACT TTAGTCTCAG
1451  AGGAGACCAA CACCCATCAC TCCACGAGTG GAAAGGAAAC AGAAGGAACT
1501  TTGAATACAT CTATGACTCC ACTTGAGACC TCTGCTCCTG GAGAAGAGTC
1551  CGAAATGACT GCCACCTTGG TCCCCACTCT AGGTTTTACA ACTCTTGACA
1601  GCAAGATCAG AAGTCCATCT CAGGTCTCTT CATCCCACCC AACAAGAGAG
1651  CTCAGAACCA CAGGCAGCAC CTCTGGGAGG CAGAGTTCCA GCACAGCTGC
1701  CCACGGGAGC TCTGACATCC TGAGGGCAAC CACTTCCAGC ACCTCAAAAG
1751  CATCATCATG GACCAGTGAA AGCACAGCTC AGCAATTTAG TGAACCCCAG
1801  CACACACAGT GGGTGGAGAC AAGTCCTAGC ATGAAAACAG AGAGACCCCC
1851  AGCATCAACC AGTGTGGCAG CCCCTATCAC CACTTCTGTT CCCTCAGTGG
1901  TCTCTGGCTT CACCACCCTG AAGACCAGCT CCACAAAAGG GATTTGGCTT
1951  GAAGAAACAT CTGCAGACAC ACTCATCGGA GAATCCACAG CTGGCCCAAC
2001  CACCCATCAG TTTGCTGTTC CCACTGGGAT TTCAATGACA GGAGGCAGCA
2051  GCACCAGGGG AAGCCAGGGC ACAACCCACC TACTCACCAG AGCCACAGCA
2101  TCATCTGAGA CATCCGCAGA TTTGACTCTG GCCACGAACG GTGTCCCAGT
```

TABLE 24-continued

DNA Sequence of the CA125 Amino Terminal Extension
(SEQ ID NO: 309)

```
2151  CTCCGTGTCT CCAGCAGTGA GCAAGACGGC TGCTGGCTCA AGTCCTCCAG
2201  GAGGGACAAA GCCATCATAT ACAATGGTTT CTTCTGTCAT CCCTGAGACA
2251  TCATCTCTAC AGTCCTCAGC TTTCAGGGAA GGAACCAGCC TGGGACTGAC
2301  TCCATTAAAC ACTAGACATC CCTTCTCTTC CCCTGAACCA GACTCTGCAG
2351  GACACACCAA GATAAGCACC AGCATTCCTC TGTTGTCATC TGCTTCAGTT
2401  CTTGAGGATA AAGTGTCAGC GACCAGCACA TTCTCACACC ACAAAGCCAC
2451  CTCATCTATT ACCACAGGGA CTCCTGAAAT CTCAACAAAG ACAAAGCCCA
2501  GCTCAGCCGT TCTTTCCTCC ATGACCCTAA GCAATGCAGC AACAAGTCCT
2551  GAAAGAGTCA GAAATGCAAC TTCCCCTCTG ACTCATCCAT CTCCATCAGG
2601  GGAAGAGACA GCAGGGAGTG TCCTCACTCT CAGCACCTCT GCTGAGACTA
2651  CAGACTCACC TAACATCCAC CCAACTGGGA CACTGACTTC AGAATCGTCA
2701  GAGAGTCCTA GCACTCTCAG CCTCCCAAGT GTCTCTGGAG TCAAAACCAC
2751  ATTTTCTTCA TCTACTCCTT CCACTCATCT ATTTACTAGT GGAGAAGAAA
2801  CAGAGGAAAC TTCGAATCCA TCTGTGTCTC AACCTGAGAC TTCTGTTTCC
2851  AGAGTAAGGA CCACCTTGGC CAGCACCTCT GTCCCTACCC AGTATTCCC
2901  CACCATGGAC ACCTGGCCTA CACGTTCAGC TCAGTTCTCT TCATCCCACC
2951  TAGTGAGTGA GCTCAGAGCT ACGAGCAGTA CCTCAGTTAC AAACTCAACT
3001  GGTTCAGCTC TTCCTAAAAT ATCTCACCTC ACTGGGACGG CAACAATGTC
3051  ACAGACCAAT AGAGACACGT TTAATGACTC TGCTGCACCC CAAAGCACAA
3101  CTTGGCCAGA GACTAGTCCC AGATTCAAGA CAGGGTTACC TTCAGCAACA
3151  ACCACTGTTT CAACCTCTGC CACTTCTCTC TCTGCTACTG TAATGGTCTC
3201  TAAATTCACT TCTCCAGCAA CTAGTTCCAT GGAAGCAACT TCTATCAGGG
3251  AACCATCAAC AACCATCCTC ACAACAGAGA CCACGAATGG CCCAGGCTCT
3301  ATGGCTGTGG CTTCTACCAA CATCCCAATT GGAAAGGGCT ACATTACTGA
3351  AGGAAGATTG GACACAAGCC ATCTGCCCAT TGGAACCACA GCTTCCTCTG
3401  AGACATCTAT GGATTTTACC ATGGCCAAAG AAAGTGTCTC AATGTCAGTA
3451  TCTCCATCTC AGTCCATGGA TGCTGCTGGC TCAAGCACTC CAGGAAGGAC
3501  AAGCCAATTC GTTGACACAT TTTCTGATGA TGTCTATCAT TTAACATCCA
3551  GAGAAATTAC AATACCTAGA GATGGAACAA GCTCAGCTCT GACTCCACAA
3601  ATGACTGCAA CTCACCCTCC ATCTCCTGAT CCTGGCTCTG CTAGAAGCAC
3651  CTGGCTTGGC ATCTTGTCCT CATCTCCTTC TTCTCCTACT CCCAAAGTCA
3701  CAATGAGCTC CACATTTTCA ACTCAGAGAG TCACCACAAG CATGATAATG
3751  GACACAGTTG AAACTAGTCG GTGGAACATG CCCAACTTAC CTTCCACGAC
3801  TTCCCTGACA CCAAGTAATA TTCCAACAAG TGGTGCCATA GGAAAAAGCA
3851  CCCTGGTTCC CTTGGACACT CCATCTCCAG CCACATCATT GGAGGCATCA
3901  GAAGGGGGAC TTCAACCCCT CAGCACCTAC CCTGAATCAA CAAACACACC
3951  CAGCATCCAC CTCGGAGCAC ACGCTAGTTC AGAAAGTCCA AGCACCATCA
4001  AACTTACCAT GGCTTCAGTA GTAAAACCTG GCTCTTACAC ACCTCTCACC
```

TABLE 24-continued

DNA Sequence of the CA125 Amino Terminal Extension
(SEQ ID NO: 309)

| | |
|---|---|
| 4051 | TTCCCCTCAA TAGAGACCCA CATTCATGTA TCAACAGCCA GAATGGCTTA |
| 4101 | CTCTTCTGGG TCTTCACCTG AGATGACAGC TCCTGGAGAG ACTAACACTG |
| 4151 | GTAGTACCTG GGACCCCACC ACCTACATCA CCACTACGGA TCCTAAGGAT |
| 4201 | ACAAGTTCAG CTCAGGTCTC TACACCCCAC TCAGTGAGGA CACTCAGAAC |
| 4251 | CACAGAAAAC CATCCAAAGA CAGAGTCCGC CACCCCAGCT GCTTACTCTG |
| 4301 | GAAGTCCTAA AATCTCAAGT TCACCCAATC TCACCAGTCC GGCCACAAAA |
| 4351 | GCATGGACCA TCACAGACAC AACTGAACAC TCCACTCAAT TACATTACAC |
| 4401 | AAAATTGGCA GAAAAATCAT CTGGATTTGA GACACAGTCA GCTCCAGGAC |
| 4451 | CTGTCTCTGT AGTAATCCCT ACCTCCCCTA CCATTGGAAG CAGCACATTG |
| 4501 | GAACTAACTT CTGATGTCCC AGGGGAACCC CTGGTCCTTG CTCCCAGTGA |
| 4551 | GCAGACCACA ATCACTCTCC CCATGGCAAC ATGGCTGAGT ACCAGTTTGA |
| 4601 | CAGAGGAAAT GGCTTCAACA GACCTTGATA TTTCAAGTCC AAGTTCACCC |
| 4651 | ATGAGTACAT TTGCTATTTT TCCACCTATG TCCACACCTT CTCATGAACT |
| 4701 | TTCAAAGTCA GAGGCAGATA CCAGTGCCAT TAGAAATACA GATTCAACAA |
| 4751 | CGTTGGATCA GCACCTAGGA ATCAGGAGTT TGGGCAGAAC TGGGGACTTA |
| 4801 | ACAACTGTTC CTATCACCCC ACTGACAACC ACGTGGACCA GTGTGATTGA |
| 4851 | ACACTCAACA CAAGCACAGG ACACCCTTTC TGCAACGATG AGTCCTACTC |
| 4901 | ACGTGACACA GTCACTCAAA GATCAAACAT CTATACCAGC CTCAGCATCC |
| 4951 | CCTTCCCATC TTACTGAAGT CTACCCTGAG CTCGGGCACA AGGGAGAAG |
| 5001 | CTCCTCTGAG GCAACCACTT TTTGGAAACC ATCTACAGAC ACACTGTCCA |
| 5051 | GAGAGATTGA GACTGGCCCA ACAAACATTC AATCCACTCC ACCCATGGAC |
| 5101 | AACACAACAA CAGGGAGCAG TAGTAGTGGA GTCACCCTGG GCATAGCCCA |
| 5151 | CCTTCCCATA GGAACATCCT CCCCAGCTGA GACATCCACA AACATGGCAC |
| 5201 | TGGAAAGAAG AAGTTCTACA GCCACTGTCT CTATGGCTGG GACAATGGGA |
| 5251 | CTCCTTGTTA CTAGTGCTCC AGGAAGAAGC ATCAGCCAGT CATTAGGAAG |
| 5301 | AGTTTCCTCT GTCCTTTCTG AGTCAACTAC TGAAGGAGTC ACAGATTCTA |
| 5351 | GTAAGGGAAG CAGCCCAAGG CTGAACACAC AGGGAAATAC AGCTCTCTCC |
| 5401 | TCCTCTCTTG AACCCAGCTA TGCTGAAGGA AGCCAGATGA GCACAAGCAT |
| 5451 | CCCTCTAACC TCATCTCCTA CAACTCCTGA TGTGGAATTC ATAGGGGGCA |
| 5501 | GCACATTTTG GACCAAGGAG GTCACCACAG TTATGACCTC AGACATCTCC |
| 5551 | AAGTCTTCAG CAAGGACAGA GTCCAGCTCA GCTACCCTTA TGTCCACAGC |
| 5601 | TTTGGGAAGC ACTGAAAATA CAGGAAAAGA AAAACTCAGA ACTGCCTCTA |
| 5651 | TGGATCTTCC ATCTCCAACT CCATCAATGG AGGTGACACC ATGGATTTCT |
| 5701 | CTCACTCTCA GTAATGCCCC CAATACCACA GATTCACTTG ACCTCAGCCA |
| 5751 | TGGGGTGCAC ACCAGCTCTG CAGGGACTTT GGCCACTGAC AGGTCATTGA |
| 5801 | ATACTGGTGT CACTAGAGCC TCCAGATTGG AAAACGGCTC TGATACCTCT |
| 5851 | TCTAAGTCCC TGTCTATGGG AAACAGCACT CACACTTCCA TGACTGACAC |
| 5901 | AGAGAAGAGT GAAGTGTCTT CTTCAATCCA TCCCCGACCT GAGACCTCAG |
| 5951 | CTCCTGGAGC AGAGACCACT TTGACTTCCA CTCCTGGAAA CAGGGCCATA |

TABLE 24-continued

DNA Sequence of the CA125 Amino Terminal Extension
(SEQ ID NO: 309)

```
6001  AGCTTAACAT TGCCTTTTTC ATCCATTCCA GTGGAAGAAG TCATTTCTAC
6051  AGGCATAACC TCAGGACCAG ACATCAACTC AGCACCCATG ACACATTCTC
6101  CCATCACCCC ACCAACAATT GTATGGACCA GTACAGGCAC AATTGAACAG
6151  TCCACTCAAC CACTACATGC AGTTTCTTCA GAAAAGTTT CTGTGCAGAC
6201  ACAGTCAACT CCATATGTCA ACTCTGTGGC AGTGTCTGCT TCCCCTACCC
6251  ATGAGAATTC AGTCTCTTCT GGAAGCAGCA CATCCTCTCC ATATTCCTCA
6301  GCCTCACTTG AATCCTTGGA TTCCACAATC AGTAGGAGGA ATGCAATCAC
6351  TTCCTGGCTA TGGGACCTCA CTACATCTCT CCCCACTACA ACTTGGCCAA
6401  GTACTAGTTT ATCTGAGGCA CTGTCCTCAG GCCATTCTGG GGTTTCAAAC
6451  CCAAGTTCAA CTACGACTGA ATTTCCACTC TTTTCAGCTG CATCCACATC
6501  TGCTGCTAAG CAAAGAAATC AGAAACAGA GACCCATGGT CCCCAGAATA
6551  CAGCCGCGAG TACTTTGAAC ACTGATGCAT CCTCGGTCAC AGGTCTTTCT
6601  GAGACTCCTG TGGGGCAAG TATCAGCTCT GAAGTCCCTC TTCCAATGGC
6651  CATAACTTCT AGATCAGATG TTTCTGGCCT TACATCTGAG AGTACTGCTA
6701  ACCCGAGTTT AGGCACAGCC TCTTCAGCAG GGACCAAATT AACTAGGACA
6751  ATATCCCTGC CCACTTCAGA GTCTTTGGTT TCCTTTAGAA TGAACAAGGA
6801  TCCATGGACA GTGTCAATCC CTTTGGGGTC CCATCCAACT ACTAATACAG
6851  AAACAAGCAT CCCAGTAAAC AGCGCAGGTC CACCTGGCTT GTCCACAGTA
6901  GCATCAGATG TAATTGACAC ACCTTCAGAT GGGGCTGAGA GTATTCCCAC
6951  TGTCTCCTTT TCCCCCTCCC CTGATACTGA AGTGACAACT ATCTCACATT
7001  TCCCAGAAAA GACAACTCAT TCATTTAGAA CCATTTCATC TCTCACTCAT
7051  GAGTTGACTT CAAGAGTGAC ACCTATTCCT GGGGATTGGA TGAGTTCAGC
7101  TATGTCTACA AAGCCCACAG GAGCCAGTCC CTCCATTACA CTGGGAGAGA
7151  GAAGGACAAT CACCTCTGCT GCTCCAACCA CTTCCCCCAT AGTTCTCACT
7201  GCTAGTTTCA CAGAGACCAG CACAGTTTCA CTGGATAATG AAACTACAGT
7251  AAAAACCTCA GATATCCTTG ACGCACGGAA AACAAATGAG CTCCCCTCAG
7301  ATAGCAGTTC TTCTTCTGAT CTGATCAACA CCTCCATAGC TTCTTCAACT
7351  ATGGATGTCA CTAAAACAGC CTCCATCAGT CCCACTAGCA TCTCAGGAAT
7401  GACAGCAAGT TCCTCCCCAT CTCTCTTCTC TTCAGATAGA CCCCAGGTTC
7451  CCACATCTAC AACAGAGACA AATACAGCCA CCTCTCCATC TGTTTCCAGT
7501  AACACCTATT CTCTTGATGG GGGCTCCAAT GTGGGTGGCA CTCCATCCAC
7551  TTTACCACCC TTTACAATCA CCCACCCTGT CGAGACAAGC TCGGCCCTAT
7601  TAGCCTGGTC TAGACCAGTA AGAACTTTCA GCACCATGGT CAGCACTGAC
7651  ACTGCCTCCG GAGAAAATCC TACCTCTAGC AATTCTGTGG TGACTTCTGT
7701  TCCAGCACCA GGTACATGGA CCAGTGTAGG CAGTACTACT GACTTACCTG
7751  CCATGGGCTT TCTCAAGACA AGTCCTGCAG GAGAGGCACA CTCACTTCTA
7801  GCATCAACTA TTGAACCAGC CACTGCCTTC ACTCCCCATC TCTCAGCAGC
7851  AGTGGTCACT GGATCCAGTG CTACATCAGA AGCCAGTCTT CTCACTACGA
```

TABLE 24-continued

DNA Sequence of the CA125 Amino Terminal Extension
(SEQ ID NO: 309)

| | |
|---|---|
| 7901 | GTGAAAGCAA AGCCATTCAT TCTTCACCAC AGACCCCAAC TACACCCACC |
| 7951 | TCTGGAGCAA ACTGGGAAAC TTCAGCTACT CCTGAGAGCC TTTTGGTAGT |
| 8001 | CACTGAGACT TCAGACACAA CACTTACCTC AAAGATTTTG GTCACAGATA |
| 8051 | CCATCTTGTT TTCAACTGTG TCCACGCCAC CTTCTAAATT TCCAAGTACG |
| 8101 | GGGACTCTGT CTGGAGCTTC CTTCCCTACT TTACTCCCGG ACACTCCAGC |
| 8151 | CATCCCTCTC ACTGCCACTG AGCCAACAAG TTCATTAGCT ACATCCTTTG |
| 8201 | ATTCCACCCC ACTGGTGACT ATAGCTTCGG ATAGTCTTGG CACAGTCCCA |
| 8251 | GAGACTACCC TGACCATGTC AGAGACCTCA AATGGTGATG CACTGGTTCT |
| 8301 | TAAGACAGTA AGTAACCCAG ATAGGAGCAT CCCTGGAATC ACTATCCAAG |
| 8351 | GAGTAACAGA AAGTCCACTC CATCCTTCTT CCACTTCCCC CTCTAAGATT |
| 8401 | GTTGCTCCAC GGAATACAAC CTATGAAGGT TCGATCACAG TGGCACTTTC |
| 8451 | TACTTTGCCT GCGGGAACTA CTGGTTCCCT TGTATTCAGT CAGAGTTCTG |
| 8501 | AAAACTCAGA GACAACGGCT TTGGTAGACT CATCAGCTGG GCTTGAGAGG |
| 8551 | GCATCTGTGA TGCCACTAAC CACAGGAAGC CAGGGTATGG CTAGCTCTGG |
| 8601 | AGGAATCAGA AGTGGGTCCA CTCACTCAAC TGGAACCAAA ACATTTTCTT |
| 8651 | CTCTCCCTCT GACCATGAAC CCAGGTGAGG TTACAGCCAT GTCTGAAATC |
| 8701 | ACCACGAACA GACTGACAGC TACTCAATCA ACAGCACCCA AAGGGATACC |
| 8751 | TGTGAAGCCC ACCAGTGCTG AGTCAGGCCT CCTAACACCT GTCTCTGCCT |
| 8801 | CCTCAAGCCC ATCAAAGGCC TTTGCCTCAC TGACTACAGC TCCCCCAACT |
| 8851 | TGGGGGATCC CACAGTCTAC CTTGACATTT GAGTTTTCTG AGGTCCCAAG |
| 8901 | TTTGGATACT AAGTCCGCTT CTTTACCAAC TCCTGGACAG TCCCTGAACA |
| 8951 | CCATTCCAGA CTCAGATGCA AGCACAGCAT CTTCCTCACT GTCCAAGTCT |
| 9001 | CCAGAAAAAA ACCCAAGGGC AAGGATGATG ACTTCCACAA AGGCCATAAG |
| 9051 | TGCAAGCTCA TTTCAATCAA CAGGTTTTAC TGAAACCCCT GAGGGATCTG |
| 9101 | CCTCCCCTTC TATGGCAGGG CATGAACCCA GAGTCCCCAC TTCAGGAACA |
| 9151 | GGGGACCCTA GATATGCCTC AGAGAGCATG TCTTATCCAG ACCCAAGCAA |
| 9201 | GGCATCATCA GCTATGACAT CGACCTCTCT TGCATCAAAA CTCACAACTC |
| 9251 | TCTTCAGCAC AGGTCAAGCA GCAAGGTCTG GTTCTAGTTC CTCTCCCATA |
| 9301 | AGCCTATCCA CTGAGAAAGA AACAAGCTTC CTTTCCCCCA CTGCATCCAC |
| 9351 | CTCCAGAAAG ACTTCACTAT TTCTTGGGCC TTCCATGGCA AGGCAGCCCA |
| 9401 | ACATATTGGT GCATCTTCAG ACTTCAGCTC TGACACTTTC TCCAACATCC |
| 9451 | ACTCTAAATA TGTCCCAGGA GGAGCCTCCT GAGTTAACCT CAAGCCAGAC |
| 9501 | CATTGCAGAA GAAGAGGGAA CAACAGCTGA ACACAGACG TTAACCTTCA |
| 9551 | CACCATCTGA GACCCCAACA TCCTTGTTAC CTGTCTCTTC TCCCACAGAA |
| 9601 | CCCACAGCCA GAAGAAAGAG TTCTCCAGAA ACATGGGCAA GCTCTATTTC |
| 9651 | AGTTCCTGCC AAGACCTCCT TGGTTGAAAC AACTGATGGA ACGCTAGTGA |
| 9701 | CCACCATAAA GATGTCAAGC CAGGCAGCAC AAGGAAATTC CACGTGGCCT |
| 9751 | GCCCCAGCAG AGGAGACGGG GACCAGTCCA GCAGGCACAT CCCCAGGAAG |
| 9801 | CCCAGAAATG TCTACCACTC TCAAAATCAT GAGCTCCAAG GAACCCAGCA |

TABLE 24-continued

DNA Sequence of the CA125 Amino Terminal Extension
(SEQ ID NO: 309)

```
 9851  TCAGCCCAGA GATCAGGTCC ACTGTGCGAA ATTCTCCTTG GAAGACTCCA
 9901  GAAACAACTG TTCCCATGGA GACCACAGTG GAACCAGTCA CCCTTCAGTC
 9951  CACAGCCCTA GGAAGTGGCA GCACCAGCAT CTCTCACCTG CCCACAGGAA
10001  CCACATCACC AACCAAGTCA CCAACAGAAA ATATGTTGGC TACAGAAAGG
10051  GTCTCCCTCT CCCCATCCCC ACCTGAGGCT TGGACCAACC TTTATTCTGG
10101  AACTCCAGGA GGGACCAGGC AGTCACTGGC ACAATGTCC  TCTGTCTCCC
10151  TAGAGTCACC AACTGCTAGA AGCATCACAG GGACTGGTCA GCAAAGCAGT
10201  CCAGAACTGG TTTCAAAGAC AACTGGAATG GAATTCTCTA TGTGGCATGG
10251  CTCTACTGGA GGGACCACAG GGGACACACA TGTCTCTCTG AGCACATCTT
10301  CCAATATCCT TGAAGACCCT GTAACCAGCC CAAACTCTGT GAGCTCATTG
10351  ACAGATAAAT CCAAACATAA AACCGAGACA TGGGTAAGCA CCACAGCCAT
10401  TCCCTCCACT GTCCTGAATA ATAAGATAAT GGCAGCTGAA CAACAGACAA
10451  GTCGATCTGT GGATGAGGCT TATTCATCAA CTAGTTCTTG GTCAGATCAG
10501  ACATCTGGGA GTGACATCAC CCTTGGTGCA TCTCCTGATG TCACAAACAC
10551  ATTATACATC ACCTCCACAG CACAAACCAC CTCACTAGTG TCTCTGCCCT
10601  CTGGAGACCA AGGCATTACA AGCCTCACCA ATCCCTCAGG AGGAAAAACA
10651  AGCTCTGCGT CATCTGTCAC ATCTCCTTCA ATAGGGCTTG AGACTCTGAG
10701  GGCCAATGTA AGTGCAGTGA AAAGTGACAT TGCCCCTACT GCTGGGCATC
10751  TATCTCAGAC TTCATCTCCT GCGGAAGTGA GCATCCTGGA CGTAACCACA
10801  GCTCCTACTC CAGGTATCTC CACCACCATC ACCACCATGG GAACCAACTC
10851  AATCTCAACT ACCACACCCA ACCCAGAAGT GGGTATGAGT ACCATGGACA
10901  GCACCCCGGC CACAGAGAGG CGCACAACTT CTACAGAACA CCCTTCCACC
10951  TGGTCTTCCA CAGCTGCATC AGATTCCTGG ACTGTCACAG ACATGACTTC
11001  AAACTTGAAA GTTGCAAGAT CTCCTGGAAC AATTTCCACA ATGCATACAA
11051  CTTCATTCTT AGCCTCAAGC ACTGAATTAG ACTCCATGTC TACTCCCCAT
11101  GGCCGTATAA CTGTCATTGG AACCAGCCTG GTCACTCCAT CCTCTGATGC
11151  TTCAGCTGTA AAGACAGAGA CCAGTACAAG TGAAAGAACA TTGAGTCCTT
11201  CAGACACAAC TGCATCTACT CCCATCTCAA CTTTTTCTCG TGTCCAGAGG
11251  ATGAGCATCT CAGTTCCTGA CATTTTAAGT ACAAGTTGGA CTCCCAGTAG
11301  TACAGAAGCA GAAGATGTGC CTGTTTCAAT GGTTTCTACA GATCATGCTA
11351  GTACAAAGAC TGACCCAAAT ACGCCCCTGT CCACTTTTCT GTTTGATTCT
11401  CTGTCCACTC TTGACTGGGA CACTGGGAGA TCTCTGTCAT CAGCCACAGC
11451  CACTACCTCA GCTCCTCAGG GGGCCACAAC TCCCCAGGAA CTCACTTTGG
11501  AAACCATGAT CAGCCCAGCT ACCTCACAGT TGCCCTTCTC TATAGGGCAC
11551  ATTACAAGTG CAGTCACACC AGCTGCAATG CAAGGAGCT CTGGAGTTAC
11601  TTTTTCAAGA CCAGATCCCA CAAGCAAAAA GGCAGAGCAG ACTTCCACTC
11651  AGCTTCCCAC CACCACTTCT GCACATCCAG GCAGGTGCC  CAGATCAGCA
11701  GCAACAACTC TGGATGTGAT CCCACACACA GCAACAACTC CAGATGCAAC
```

TABLE 24-continued

DNA Sequence of the CA125 Amino Terminal Extension
(SEQ ID NO: 309)

| | | | | |
|---|---|---|---|---|
| 11751 | TTTTCAGAGA | CAAGGGCAGA | CAGCTCTTAC | AACAGAGGCA | AGAGCTACAT |
| 11801 | CTGACTCCTG | GAATGAGAAA | GAAAAATCAA | CCCCAAGTGC | ACCTTGGATC |
| 11851 | ACTGAGATGA | TGAATTCTGT | CTCAGAAGAT | ACCATCAAGG | AGGTTACCAG |
| 11901 | CTCCTCCAGT | GTATTAAAGG | ACCCTGAATA | CGCTGGACAT | AAACTTGGAA |
| 11951 | TCTGGGACGA | CTTCATCCCC | AAGTTTGGAA | AAGCAGCCCA | TATGAGAGAG |
| 12001 | TTGCCCCTTC | TGAGTCCACC | ACAGGACAAA | GAGGCAATTC | ACCCTTCTAC |
| 12051 | AAACACAGTA | GAGACCACAG | GCTGGGTCAC | AAGTTCCGAA | CATGCTTCTC |
| 12101 | ATTCCACTAT | CCCAGCCCAC | TCAGCGTCAT | CCAAACTCAC | ATCTCCAGTG |
| 12151 | GTTACAACCT | CCACCAGGGA | ACAAGCAATA | GTTTCTATGT | CAACAACCAC |
| 12201 | ATGGCCAGAG | TCTACAAGGG | CTAGAACAGA | GCCTAATTCC | TTCTTGACTA |
| 12251 | TTGAACTGAG | GGACGTCAGC | CCTTACATGG | ACACCAGCTC | AACCACACAA |
| 12301 | ACAAGTATTA | TCTCTTCCCC | AGGTTCCACT | GCGATCACCA | AGGGGCCTAG |
| 12351 | AACAGAAATT | ACCTCCTCTA | AGAGAATATC | CAGCTCATTC | CTTGCCCAGT |
| 12401 | CTATGAGGTC | GTCAGACAGC | CCCTCAGAAG | CCATCACCAG | GCTGTCTAAC |
| 12451 | TTTCCTGCCA | TGACAGAATC | TGGAGGAATG | ATCCTTGCTA | TGCAAACAAG |
| 12501 | TCCACCTGGC | GCTACATCAC | TAAGTGCACC | TACTTTGGAT | ACATCAGCCA |
| 12551 | CAGCCTCCTG | GACAGGGACT | CCACTGGCTA | CGACTCAGAG | ATTTACATAC |
| 12601 | TCAGAGAAGA | CCACTCTCTT | TAGCAAAGGT | CCTGAGGATA | CATCACAGCC |
| 12651 | AAGCCCTCCC | TCTGTGGAAG | AAACCAGCTC | TTCCTCTTCC | CTGGTACCTA |
| 12701 | TCCATGCTAC | AACCTCGCCT | TCCAATATTT | TGTTGACATC | ACAAGGGCAC |
| 12751 | AGTCCCTCCT | CTACTCCACC | TGTGACCTCA | GTTTTCTTGT | CTGAGACCTC |
| 12801 | TGGCCTGGGG | AAGACCACAG | ACATGTCGAG | GATAAGCTTG | GAACCTGGCA |
| 12851 | CAAGTTTACC | TCCCAATTTG | AGCAGTACAG | CAGGTGAGGC | GTTATCCACT |
| 12901 | TATGAAGCCT | CCAGAGATAC | AAAGGCAATT | CATCATTCTG | CAGACACAGC |
| 12951 | AGTGACGAAT | ATGGAGGCAA | CCAGTTCTGA | ATATTCTCCT | ATCCCAGGCC |
| 13001 | ATACAAAGCC | ATCCAAAGCC | ACATCTCCAT | TGGTTACCTC | CCACATCATG |
| 13051 | GGGGACATCA | CTTCTTCCAC | ATCAGTATTT | GGCTCCTCCG | AGACCACAGA |
| 13101 | GATTGAGACA | GTGTCCTCTG | TGAACCAGGG | ACTTCAGGAG | AGAAGCACAT |
| 13151 | CCCAGGTGGC | CAGCTCTGCT | ACAGAGACAA | GCACTGTCAT | TACCCATGTG |
| 13201 | TCTAGTGGTG | ATGCTACTAC | TCATGTCACC | AAGACACAAG | CCACTTTCTC |
| 13251 | TAGCGGAACA | TCCATCTCAA | GCCCTCATCA | GTTTATAACT | TCTACCAACA |
| 13301 | CATTTACAGA | TGTGAGCACC | AACCCCTCCA | CCTCTCTGAT | AATGACAGAA |
| 13351 | TCTTCAGGAG | TGACCATCAC | CACCCAAACA | GGTCCTACTG | GAGCTGCAAC |
| 13401 | ACAGGGTCCA | TATCTCTTGG | ACACATCAAC | CATGCCTTAC | TTGACAGAGA |
| 13451 | CTCCATTAGC | TGTGACTCCA | GATTTTATGC | AATCAGAGAA | GACCACTCTC |
| 13501 | ATAAGCAAAG | GTCCCAAGGA | TGTGACCTGG | ACAAGCCCTC | CCTCTGTGGC |
| 13551 | AGAAACCAGC | TATCCCTCTT | CCCTGACACC | TTTCTTGGTC | ACAACCATAC |
| 13601 | CTCCTGCCAC | TTCCACGTTA | CAAGGGCAAC | ATACATCCTC | TCCTGTTTCT |
| 13651 | GCGACTTCAG | TTCTTACCTC | TGGACTGGTG | AAGACCACAG | ATATGTTGAA |

TABLE 24-continued

DNA Sequence of the CA125 Amino Terminal Extension
(SEQ ID NO: 309)

```
13701  CACAAGCATG GAACCTGTGA CCAATTCACC TCAAAATTTG AACAATCCAT
13751  CAAATGAGAT ACTGGCCACT TTGGCAGCCA CCACAGATAT AGAGACTATT
13801  CATCCTTCCA TAAACAAAGC AGTGACCAAT ATGGGGACTG CCAGTTCAGC
13851  ACATGTACTG CATTCCACTC TCCCAGTCAG CTCAGAACCA TCTACAGCCA
13901  CATCTCCAAT GGTTCCTGCC TCCAGCATGG GGACGCTCT  TGCTTCTATA
13951  TCAATACCTG GTTCTGAGAC CACAGACATT GAGGGAGAGC CAACATCCTC
14001  CCTGACTGCT GGACGAAAAG AGAACAGCAC CCTCCAGGAG ATGAACTCAA
14051  CTACAGAGTC AAACATCATC CTCTCCAATG TGTCTGTGGG GGCTATTACT
14101  GAAGCCACAA AAATGGAAGT CCCCTCTTTT GATGCAACAT TCATACCAAC
14151  TCCTGCTCAG TCAACAAAGT CCCAGATAT  TTTCTCAGTA GCCAGCAGTA
14201  GACTTTCAAA CTCTCCTCCC ATGACAATAT CTACCCACAT GACCACCACC
14251  CAGACAGGGT CTTCTGGAGC TACATCAAAG ATTCCACTTG CCTTAGACAC
14301  ATCAACCTTG GAAACCTCAG CAGGGACTCC ATCAGTGGTG ACTGAGGGGT
14351  TTGCCCACTC AAAAATAACC ACTGCAATGA ACAATGATGT CAAGGACGTG
14401  TCACAGACAA ACCCTCCCTT TCAGGATGAA GCCAGCTCTC CCTCTTCTCA
14451  AGCACCTGTC CTTGTCACAA CCTTACCTTC TTCTGTTGCT TTCACACCGC
14501  AATGGCACAG TACCTCCTCT CCTGTTTCTA TGTCCTCAGT TCTTACTTCT
14551  TCACTGGTAA AGACCGCAGG CAAGGTGGAT ACAAGCTTAG AAACAGTGAC
14601  CAGTTCACCT CAAAGTATGA GCAACACTTT GGATGACATA TCGGTCACTT
14651  CAGCAGCCAC CACAGATATA GAGACAACGC ATCCTTCCAT AAACACAGTA
14701  GTTACCAATG TGGGGACCAC CGGTTCAGCA TTTGAATCAC ATTCTACTGT
14751  CTCAGCTTAC CCAGAGCCAT CTAAAAGTCA CATTCTCCCA ATGTTACCAC
14801  CTCCACCATG GAAGACACCA CAATTTCCAC GATCAATACC TAAATCCTCT
14851  AAGACTACAA GAACTGAGAC TGAGACAACT TCCTCCCTGA CTCCTAAACT
14901  GAGGGAGACC AGCATCTCCC AGGAGATCAC CTCGTCCACA GAGACAAGCA
14951  CTGTTCCTTA CAAAGAGCTC ACTGGTGCCA CTACCGAGGT ATCCAGGACA
15001  GATGTCACTT CCTCTAGCAG TACATCCTTC CCTGGCCCTG ATCAGTCCAC
15051  AGTGTCACTA GACATCTCCA CAGAAACCAA CACCAGGCTG TCTACCTCCC
15101  CAATAATGAC AGAATCTGCA GAAATAACCA TCACCACCCA AACAGGTCCT
15151  CATGGGGCTA CATCACAGGA TACTTTTACC ATGGACCCAT CAAATACAAC
15201  CCCCCAGGCA GGGATCCACT CAGCTATGAC TCATGGATTT TCACAATTGG
15251  ATGTGACCAC TCTTATGAGC AGAATTCCAC AGGATGTATC ATGGACAAGT
15301  CCTCCCTCTG TGGATAAAAC CAGCTCCCCC TCTTCCTTTC TGTCCTCACC
15351  TGCAATGACC ACACCTTCCC TGATTTCTTC TACCTTACCA GAGGATAAGC
15401  TCTCCTCTCC TATGACTTCA CTTCTCACCT CTGGCCTAGT GAAGATTACA
15451  GACATATTAC GTACACGCTT GGAACCTGTG ACCAGCTCAC TTCCAAATTT
15501  CAGCAGCACC TCAGATAAGA TACTGGCCAC TTCTAAAGAC AGTAAAGACA
15551  CAAAGGAAAT TTTTCCTTCT ATAAACACAG AAGAGACCAA TGTGAAAGCC
```

TABLE 24-continued

DNA Sequence of the CA125 Amino Terminal Extension
(SEQ ID NO: 309)

```
15601  AACAACTCTG GACATGAATC CCATTCCCCT GCACTGGCTG ACTCAGAGAC
15651  ACCCAAAGCC ACAACTCAAA TGGTTATCAC ACCACTGTG  GGAGATCCAG
15701  CTCCTTCCAC ATCAATGCCA GTGCATGGTT CCTCTGAGAC TACAAACATT
15751  AAGAGAGAGC CAACATATTT CTTGACTCCT AGACTGAGAG AGACCAGTAC
15801  CTCTCAGGAG TCCAGCTTTC CCACGGACAC AAGTTTTCTA CTTTCCAAAG
15851  TCCCCACTGG TACTATTACT GAGGTCTCCA GTACAGGGGT CAACTCTTCT
15901  AGCAAAATTT CCACCCCAGA CCATGATAAG TCCACAGTGC CACCTGACAC
15951  CTTCACAGGA GAGATCCCCA GGGTCTTCAC CTCCTCTATT AAGACAAAAT
16001  CTGCAGAAAT GACGATCACC ACCCAAGCAA GTCCTCCTGA GTCTGCATCG
16051  CACAGTACCC TTCCCTTGGA CACATCAACC ACACTTTCCC AGGGAGGGAC
16101  TCATTCAACT GTGACTCAGG GATTCCCATA CTCAGAGGTG ACCACTCTCA
16151  TGGGCATGGG TCCTGGGAAT GTGTCATGGA TGACAACTCC CCCTGTGGAA
16201  GAAACCAGCT CTGTGTCTTC CCTGATGTCT TCACCTGCCA TGACATCCCC
16251  TTCTCCTGTT TCCTCCACAT CACCACAGAG CATCCCCTCC TCTCCTCTTC
16301  CTGTGACTGC ACTTCCTACT TCTGTTCTGG TGACAACCAC AGATGTGTTG
16351  GGCACAACAA GCCCAGAGTC TGTAACCAGT TCACCTCCAA ATTTGAGCAG
16401  CATCACTCAT GAGAGACCGG CCACTTACAA AGACACTGCA CACACAGAAG
16451  CCGCCATGCA TCATTCCACA AACACCGCAG TGACCAATGT AGGGACTTCC
16501  GGGTCTGGAC ATAAATCACA ATCCTCTGTC CTAGCTGACT CAGAGACATC
16551  GAAAGCCACA CCTCTGATGA GTACCACCTC CACCCTGGGG ACACAAGTG
16601  TTTCCACATC AACTCCTAAT ATCTCTCAGA CTAACCAAAT TCAAACAGAG
16651  CCAACAGCAT CCCTGAGCCC TAGACTGAGG GAGAGCAGCA CGTCTGAGAA
16701  GACCAGCTCA CAACAGAGA  CAAATACTGC CTTTTCTTAT GTGCCCACAG
16751  GTGCTATTAC TCAGGCCTCC AGAACAGAAA TCTCCTCTAG CAGAACATCC
16801  ATCTCAGACC TTGATCGGCC ACAATAGCA  CCCGACATCT CCACAGGAAT
16851  GATCACCAGG CTCTTCACCT CCCCCATCAT GACAAAATCT GCAGAAATGA
16901  CCGTCACCAC TCAAACAACT ACTCCTGGGG CTACATCACA GGGTATCCTT
16951  CCTTGGGACA CATCAACCAC ACTTTTCCAG GGAGGGACTC ATTCAACCGT
17001  GTCTCAGGGA TTCCCACACT CAGAGATAAC CACTCTTCGG AGCAGAACCC
17051  CTGGAGATGT GTCATGGATG ACAACTCCCC CTGTGGAAGA AACCAGCTCT
17101  GGGTTTTCCC TGATGTCACC TTCCATGACA TCCCCTTCTC CTGTTTCCTC
17151  CACATCACCA GAGAGCATCC CCTCCTCTCC TCTCCCTGTG ACTGCACTTC
17201  TTACTTCTGT TCTGGTGACA ACCACCAATG TATTGGGCAC AACAAGCCCA
17251  GAGACCGTAA CGAGTTCACC TCCAAATTTA AGCAGCCCCA CACAGGAGAG
17301  ACTGACCACT TACAAAGACA CTGCGCACAC AGAAGCCATG CATGCTTCCA
17351  TGCATACAAA CACTGCAGTG GCCAACGTCG GGACCTCCAT TTCTGGACAT
17401  GAATCACAAT CTTCTGTCCC AGCTGATTCA CACACATCCA AAGCCACATC
17451  TCCAATGGGT ATCACCTTCG CCATGGGGGA TACAAGTGTT CTACATCAA
17501  CTCCTGCCTT CTTTGAGACT AGAATTCAGA CTGAATCAAC ATCCTCTTTG
```

TABLE 24-continued

DNA Sequence of the CA125 Amino Terminal Extension
(SEQ ID NO: 309)

```
17551  ATTCCTGGAT TAAGGGACAC CAGGACGTCT GAGGAGATCA ACACTGTGAC
17601  AGAGACCAGC ACTGTCCTTT CAGAAGTGCC CACTACTACT ACTACTGAGG
17651  TCTCCAGGAC AGAAGTTATC ACTTCCAGCA GAACAACCAT CTCAGGGCCT
17701  GATCATTCCA AAATGTCACC CTACATCTCC ACAGAAACCA TCACCAGGCT
17751  CTCCACTTTT CCTTTTGTAA CAGGATCCAC AGAAATGGCC ATCACCAACC
17801  AAACAGGTCC TATAGGGACT ATCTCACAGG CTACCCTTAC CCTGGACACA
17851  TCAAGCACAG CTTCCTGGGA AGGGACTCAC TCACCTGTGA CTCAGAGATT
17901  TCCACACTCA GAGGAGACCA CTACTATGAG CAGAAGTACT AAGGGCGTGT
17951  CATGGCAAAG CCCTCCCTCT GTGGAAGAAA CCAGTTCTCC TTCTTCCCCA
18001  GTGCCTTTAC CTGCAATAAC CTCACATTCA TCTCTTTATT CCGCAGTATC
18051  AGGAAGTAGC CCCACTTCTG CTCTCCCTGT GACTTCCCTT CTCACCTCTG
18101  GCAGGAGGAA GACCATAGAC ATGTTGGACA CACACTCAGA ACTTGTGACC
18151  AGCTCCTTAC CAAGTGCAAG TAGCTTCTCA GGTGAGATAC TCACTTCTGA
18201  AGCCTCCACA AATACAGAGA CAATTCACTT TTCAGAGAAC ACAGCAGAAA
18251  CCAATATGGG GACCACCAAT TCTATGCATA AACTACATTC CTCTGTCTCA
18301  ATCCACTCCC AGCCATCCGG ACACACACCT CCAAAGGTTA CTGGATCTAT
18351  GATGGAGGAC GCTATTGTTT CCACATCAAC ACCTGGTTCT CCTGAGACTA
18401  AAAATGTTGA CAGAGACTCA ACATCCCCTC TGACTCCTGA ACTGAAAGAG
18451  GACAGCACCG CCCTGGTGAT GAACTCAACT ACAGAGTCAA ACACTGTTTT
18501  CTCCAGTGTG TCCCTGGATG CTGCTACTGA GGTCTCCAGG GCAGAAGTCA
18551  CCTACTATGA TCCTACATTC ATGCCAGCTT CTGCTCAGTC AACAAAGTCC
18601  CCAGACATTT CACCTGAAGC CAGCAGCAGT CATTCTAACT CTCCTCCCTT
18651  GACAATATCT ACACACAAGA CCATCGCCAC ACAAACAGGT CCTTCTGGGG
18701  TGACATCTCT TGGCCAACTG ACCCTGGACA CATCAACCAT AGCCACCTCA
18751  GCAGGAACTC CATCAGCCAG AACTCAGGAT TTTGTAGATT CAGAAACAAC
18801  CAGTGTCATG AACAATGATC TCAATGATGT GTTGAAGACA AGCCCTTTCT
18851  CTGCAGAAGA AGCCAACTCT CTCTCTTCTC AGGCACCTCT CCTTGTGACA
18901  ACCTCACCTT CTCCTGTAAC TTCCACATTG CAAGAGCACA GTACCTCCTC
18951  TCTTGTTTCT GTGACCTCAG TACCCACCCC TACACTGGCG AAGATCACAG
19001  ACATGGACAC AAACTTAGAA CCTGTGACTC GTTCACCTCA AAATTTAAGG
19051  AACACCTTGG CCACTTCAGA AGCCACCACA GATACACACA CAATGCATCC
19101  TTCTATAAAC ACAGCAATGG CCAATGTGGG GACCACCAGT TCACCAAATG
19151  AATTCTATTT TACTGTCTCA CCTGACTCAG ACCCATATAA AGCCACATCC
19201  GCAGTAGTTA TCACTTCCAC CTCGGGGGAC TCAATAGTTT CCACATCAAT
19251  GCCTAGATCC TCTGCGATGA AAAAGATTGA GTCTGAGACA ACTTTCTCCC
19301  TGATATTTAG ACTGAGGGAG ACTAGCACCT CCCAGAAAAT TGGCTCATCC
19351  TCAGACACAA GCACGGTCTT TGACAAAGCA TTCACTGCTG CTACTACTGA
19401  GGTCTCCAGA ACAGAACTCA CCTCCTCTAG CAGAACATCC ATCCAAGGCA
```

TABLE 24-continued

DNA Sequence of the CA125 Amino Terminal Extension
(SEQ ID NO: 309)

```
19451  CTGAAAAGCC CACAATGTCA CCGGACACCT CCACAAGATC TGTCACCATG
19501  CTTTCTACTT TTGCTGGCCT GACAAAATCC GAAGAAAGGA CCATTGCCAC
19551  CCAAACAGGT CCTCATAGGG CGACATCACA GGGTACCCTT ACCTGGGACA
19601  CATCAATCAC AACCTCACAG GCAGGGACCC ACTCAGCTAT GACTCATGGA
19651  TTTTCACAAT TAGATTTGTC CACTCTTACG AGTAGAGTTC CTGAGTACAT
19701  ATCAGGGACA AGCCCACCCT CTGTGGAAAA AACCAGCTCT TCCTCTTCCC
19751  TTCTGTCTTT ACCAGCAATA ACCTCACCGT CCCCTGTACC TACTACATTA
19801  CCAGAAAGTA GGCCGTCTTC TCCTGTTCAT CTGACTTCAC TCCCCACCTC
19851  TGGCCTAGTG AAGACCACAG ATATGCTGGC ATCTGTGGCC AGTTTACCTC
19901  CAAACTTGGG CAGCACCTCA CATAAGATAC CGACTACTTC AGAAGACATT
19951  AAAGATACAG AGAAAATGTA TCCTTCCACA AACATAGCAG TAACCAATGT
20001  GGGGACCACC ACTTCTGAAA AGGAATCTTA TTCGTCTGTC CCAGCCTACT
20051  CAGAACCACC CAAAGTCACC TCTCCAATGG TTACCTCTTT CAACATAAGG
20101  GACACCATTG TTTCCACATC CATGCCTGGC TCCTCTGAGA TTACAAGGAT
20151  TGAGATGGAG TCAACATTCT CCGTGGCTCA TGGGCTGAAG GGAACCAGCA
20201  CCTCCCAGGA CCCCATCGTA TCCACAGAGA AAAGTGCTGT CCTTCACAAG
20251  TTGACCACTG GTGCTACTGA GACCTCTAGG ACAGAAGTTG CCTCTTCTAG
20301  AAGAACATCC ATTCCAGGCC CTGATCATTC CACAGAGTCA CCAGACATCT
20351  CCACTGAAGT GATCCCCAGC CTGCCTATCT CCCTTGGCAT TACAGAATCT
20401  TCAAATATGA CCATCATCAC TCGAACAGGT CCTCCTCTTG GCTCTACATC
20451  ACAGGGCACA TTTACCTTGG ACACACCAAC TACATCCTCC AGGGCAGGAA
20501  CACACTCGAT GGCGACTCAG GAATTTCCAC ACTCAGAAAT GACCACTGTC
20551  ATGAACAAGG ACCCTGAGAT TCTATCATGG ACAATCCCTC CTTCTATAGA
20601  GAAAACCAGC TTCTCCTCTT CCCTGATGCC TTCACCAGCC ATGACTTCAC
20651  CTCCTGTTTC CTCAACATTA CCAAAGACCA TTCACACCAC TCCTTCTCCT
20701  ATGACCTCAC TGCTCACCCC TAGCCTAGTG ATGACCACAG ACACATTGGG
20751  CACAAGCCCA GAACCTACAA CCAGTTCACC TCCAAATTTG AGCAGTACCT
20801  CACATGAGAT ACTGACAACA GATGAAGACA CCACAGCTAT AGAAGCCATG
20851  CATCCTTCCA CAAGCACAGC AGCGACTAAT GTGGAAACCA CCAGTTCTGG
20901  ACATGGGTCA CAATCCTCTG TCCTAGCTGA CTCAGAAAAA ACCAAGGCCA
20951  CAGCTCCAAT GGATACCACC TCCACCATGG GCATACAAC TGTTTCCACA
21001  TCAATGTCTG TTTCCTCTGA GACTACAAAA ATTAAGAGAG AGTCAACATA
21051  TTCCTTGACT CCTGGACTGA GAGAGACCAG CATTTCCCAA AATGCCAGCT
21101  TTTCCACTGA CACAAGTATT GTTCTTTCAG AAGTCCCCAC TGGTACTACT
21151  GCTGAGGTCT CCAGGACAGA AGTCACCTCC TCTGGTAGAA CATCCATCCC
21201  TGGCCCTTCT CAGTCCACAG TTTTGCCAGA ATATCCACA AGAACAATGA
21251  CAAGGCTCTT TGCCTCGCCC ACCATGACAG AATCAGCAGA AATGACCATC
21301  CCCACTCAAA CAGGTCCTTC TGGGTCTACC TCACAGGATA CCCTTACCTT
21351  GGACACATCC ACCACAAAGT CCCAGGCAAA GACTCATTCA ACTTTGACTC
```

TABLE 24-continued

DNA Sequence of the CA125 Amino Terminal Extension
(SEQ ID NO: 309)

```
21401  AGAGATTTCC ACACTCAGAG ATGACCACTC TCATGAGCAG AGGTCCTGGA
21451  GATATGTCAT GGCAAAGCTC TCCCTCTCTG GAAAATCCCA GCTCTCTCCC
21501  TTCCCTGCTG TCTTTACCTG CCACAACCTC ACCTCCTCCC ATTTCCTCCA
21551  CATTACCAGT GACTATCTCC TCCTCTCCTC TTCCTGTGAC TTCACTTCTC
21601  ACCTCTAGCC CGGTAACGAC CACAGACATG TTACACACAA GCCCAGAACT
21651  TGTAACCAGT TCACCTCCAA AGCTGAGCCA CACTTCAGAT GAGAGACTGA
21701  CCACTGGCAA GGACACCACA AATACAGAAG CTGTGCATCC TTCCACAAAC
21751  ACAGCAGCGT CCAATGTGGA GATTCCCAGC TCTGGACATG AATCCCCTTC
21801  CTCTGCCTTA GCTGACTCAG AGACATCCAA AGCCACATCA CCAATGTTTA
21851  TTACCTCCAC CCAGGAGGAT ACAACTGTTG CCATATCAAC CCCTCACTTC
21901  TTGGAGACTA GCAGAATTCA GAAAGAGTCA ATTTCCTCCC TGAGCCCTAA
21951  ATTGAGGGAG ACAGGCAGTT CTGTGGAGAC AAGCTCAGCC ATAGAGACAA
22001  GTGCTGTCCT TTCTGAAGTG TCCGTTGGTG CTACTACTGA GATCTCCAGG
22051  ACAGAAGTCA CCTCCTCTAG CAGAACATCC ATCTCTGGTT CTGCTGAGTC
22101  CACAATGTTG CCAGAAATAT CCACCACAAG AAAAATCATT AAGTTCCCTA
22151  CTTCCCCCAT CCTGGCAGAA TCATCAGAAA TGACCATCAA GACCCAAACA
22201  AGTCCTCCTG GGTCTACATC AGAGAGTACC TTTACATTAG ACACATCAAC
22251  CACTCCCTCC TTGGTAATAA CCCATTCGAC TATGACTCAG AGATTGCCAC
22301  ACTCAGAGAT AACCACTCTT GTGAGTAGAG GTGCTGGGGA TGTGCCACGG
22351  CCCAGCTCTC TCCCTGTGGA AGAAACAAGC CCTCCATCTT CCCAGCTGTC
22401  TTTATCTGCC ATGATCTCAC CTTCTCCTGT TTCTTCCACA TTACCAGCAA
22451  GTAGCCACTC CTCTTCTGCT TCTGTGACTT CACTTCTCAC ACCAGGCCAA
22501  GTGAAGACTA CTGAGGTGTT GGACGCAAGT GCAGAACCTG AAACCAGTTC
22551  ACCTCCAAGT TTGAGCAGCA CCTCAGTTGA AATACTGGCC ACCTCTGAAG
22601  TCACCACAGA TACGGAGAAA ATTCATCCTT TCTCAAACAC GGCAGTAACC
22651  AAAGTTGGAA CTTCCAGTTC TGGACATGAA TCCCCTTCCT CTGTCCTACC
22701  TGACTCAGAG ACAACCAAAG CCACATCGGC AATGGGTACC ATCTCCATTA
22751  TGGGGGATAC AAGTGTTTCT ACATTAACTC CTGCCTTATC TAACACTAGG
22801  AAAATTCAGT CAGAGCCAGC TTCCTCACTG ACCACCAGAT TGAGGGAGAC
22851  CAGCACCTCT GAAGAGACCA GCTTAGCCAC AGAAGCAAAC ACTGTTCTTT
22901  CTAAAGTGTC CACTGGTGCT ACTACTGAGG TCTCCAGGAC AGAAGCCATC
22951  TCCTTTAGCA GAACATCCAT GTCAGGCCCT GAGCAGTCCA CAATGTCACA
23001  AGACATCTCC ATAGGAACCA TCCCCAGGAT TTCTGCCTCC TCTGTCCTGA
23051  CAGAATCTGC AAAAATGACC ATCACAACCC AAACAGGTCC TTCGGAGTCT
23101  ACACTAGAAA GTACCCTTAA TTTGAACACA GCAACCACAC CCTCTTGGGT
23151  GGAAACCCAC TCTATAGTAA TTCAGGGATT TCCACACCCA GAGATGACCA
23201  CTTCCATGGG CAGAGGTCCT GGAGGTGTGT CATGGCCTAG CCCTCCCTTT
23251  GTGAAAGAAA CCAGCCCTCC ATCCTCCCCG CTGTCTTTAC CTGCCGTGAC
```

TABLE 24-continued

DNA Sequence of the CA125 Amino Terminal Extension
(SEQ ID NO: 309)

```
23301  CTCACCTCAT CCTGTTTCCA CCACATTCCT AGCACATATC CCCCCCTCTC
23351  CCCTTCCTGT GACTTCACTT CTCACCTCTG GCCCGGCGAC AACCACAGAT
23401  ATCTTGGGTA CAAGCACAGA ACCTGGAACC AGTTCATCTT CAAGTTTGAG
23451  CACCACCTCC CATGAGAGAC TGACCACTTA CAAAGACACT GCACATACAG
23501  AAGCCGTGCA TCCTTCCACA AACACAGGAG GGACCAATGT GGCAACCACC
23551  AGCTCTGGAT ATAAATCACA GTCCTCTGTC CTAGCTGACT CATCTCCAAT
23601  GTGTACCACC TCCACCATGG GGGATACAAG TGTTCTCACA TCAACTCCTG
23651  CCTTCCTTGA GACTAGGAGG ATTCAGACAG AGCTAGCTTC CTCCCTGACC
23701  CCTGGATTGA GGGAGTCCAG TGGCTCTGAA GGGACCAGCT CAGGCACCAA
23751  GATGAGCACT GTCCTCTCTA AAGTGCCCAC TGGTGCTACT ACTGAGATCT
23801  CCAAGGAAGA CGTCACCTCC ATCCCAGGTC CCGCTCAATC CACAATATCA
23851  CCAGACATCT CCACAAGAAC CGTCAGCTGG TTCTCTACAT CCCCTGTCAT
23901  GACAGAATCA GCAGAAATAA CCATGAACAC CCATACAAGT CCTTTAGGGG
23951  CCACAACACA AGGCACCAGT ACTTTGGCCA CGTCAAGCAC AACCTCTTTG
24001  ACAATGACAC ACTCAACTAT ATCTCAAGGA TTTTCACACT CACAGATGAG
24051  CACTCTTATG AGGAGGGGTC CTGAGGATGT ATCATGGATG AGCCCTCCCC
24101  TTCTGGAAAA AACTAGACCT TCCTTTTCTC TGATGTCTTC ACCAGCCACA
24151  ACTTCACCTT CTCCTGTTTC CTCCACATTA CCAGAGAGCA TCTCTTCCTC
24201  TCCTCTTCCT GTGACTTCAC TCCTCACGTC TGGCTTGGCA AAAACTACAG
24251  ATATGTTGCA CAAAAGCTCA GAACCTGTAA CCAACTCACC TGCAAATTTG
24301  AGCAGCACCT CAGTTGAAAT ACTGGCCACC TCTGAAGTCA CCACAGATAC
24351  AGAGAAAACT CATCCTTCTT CAAACAGAAC AGTGACCGAT GTGGGGACCT
24401  CCAGTTCTGG ACATGAATCC ACTTCCTTTG TCCTAGCTGA CTCACAGACA
24451  TCCAAAGTCA CATCTCCAAT GGTTATTACC TCCACCATGG AGGATACGAG
24501  TGTCTCCACA TCAACTCCTG GCTTTTTTGA GACTAGCAGA ATTCAGACAG
24551  AACCAACATC CTCCCTGACC CTTGGACTGA GAAAGACCAG CAGCTCTGAG
24601  GGGACCAGCT TAGCCACAGA GATGAGCACT GTCCTTTCTG GAGTGCCCAC
24651  TGGTGCCACT GCTGAAGTCT CCAGGACAGA AGTCACCTCC TCTAGCAGAA
24701  CATCCATCTC AGGCTTTGCT CAGCTCACAG TGTCACCAGA GACTTCCACA
24751  GAAACCATCA CCAGACTCCC TACCTCCAGC ATAATGACAG AATCAGCAGA
24801  AATGATGATC AAGACACAAA CAGATCCTCC TGGGTCTACA CCAGAGAGTA
24851  CTCATACTGT GGACATATCA ACAACACCCA ACTGGGTAGA AACCCACTCG
24901  ACTGTGACTC AGAGATTTTC ACACTCAGAG ATGACCACTC TTGTGAGCAG
24951  AAGCCCTGGT GATATGTTAT GGCCTAGTCA ATCCTCTGTG AAGAAACCA
25001  GCTCTGCCTC TTCCCTGCTG TCTCTGCCTG CCACGACCTC ACCTTCTCCT
25051  GTTTCCTCTA CATTAGTAGA GGATTTCCCT TCCGCTTCTC TTCCTGTGAC
25101  TTCTCTTCTC ACCCCTGGCC TGGTGATAAC CACAGACAGG ATGGGCATAA
25151  GCAGAGAACC TGGAACCAGT TCCACTTCAA ATTTGAGCAG CACCTCCCAT
25201  GAGAGACTGA CCACTTTGGA AGACACTGTA GATACAGAAG ACATGCAGCC
```

TABLE 24-continued

DNA Sequence of the CA125 Amino Terminal Extension
(SEQ ID NO: 309)

```
25251  TTCCACACAC ACAGCAGTGA CCAACGTGAG GACCTCCATT TCTGGACATG
25301  AATCACAATC TTCTGTCCTA TCTGACTCAG AGACACCCAA AGCCACATCT
25351  CCAATGGGTA CCACCTACAC CATGGGGGAA ACGAGTGTTT CCATATCCAC
25401  TTCTGACTTC TTTGAGACCA GCAGAATTCA GATAGAACCA ACATCCTCCC
25451  TGACTTCTGG ATTGAGGGAG ACCAGCAGCT CTGAGAGGAT CAGCTCAGCC
25501  ACAGAGGGAA GCACTGTCCT TTCTGAAGTG CCCAGTGGTG CTACCACTGA
25551  GGTCTCCAGG ACAGAAGTGA TATCCTCTAG GGAACATCC ATGTCAGGGC
25601  CTGATCAGTT CACCATATCA CCAGACATCT CTACTGAAGC GATCACCAGG
25651  CTTTCTACTT CCCCCATTAT GACAGAATCA GCAGAAAGTG CCATCACTAT
25701  TGAGACAGGT TCTCCTGGGG CTACATCAGA GGGTACCCTC ACCTTGGACA
25751  CCTCAACAAC AACCTTTTGG TCAGGGACCC ACTCAACTGC ATCTCCAGGA
25801  TTTTCACACT CAGAGATGAC CACTCTTATG AGTAGAACTC CTGGAGATGT
25851  GCCATGGCCG AGCCTTCCCT CTGTGGAAGA AGCCAGCTCT GTCTCTTCCT
25901  CACTGTCTTC ACCTGCCATG ACCTCAACTT CTTTTTTCTC CACATTACCA
25951  GAGAGCATCT CCTCCTCTCC TCATCCTGTG ACTGCACTTC TCACCCTTGG
26001  CCCAGTGAAG ACCACAGACA TGTTGCGCAC AAGCTCAGAA CCTGAAACCA
26051  GTTCACCTCC AAATTTGAGC AGCACCTCAG CTGAAATATT AGCCACGTCT
26101  GAAGTCACCA AAGATAGAGA GAAAATTCAT CCCTCCTCAA ACACACCTGT
26151  AGTCAATGTA GGGACTGTGA TTTATAAACA TCTATCCCCT TCCTCTGTTT
26201  TGGCTGACTT AGTGACAACA AAACCCACAT CTCCAATGGC TACCACCTCC
26251  ACTCTGGGGA ATACAAGTGT TTCCACATCA ACTCCTGCCT TCCCAGAAAC
26301  TATGATGACA CAGCCAACTT CCTCCCTGAC TTCTGGATTA AGGGAGATCA
26351  GTACCTCTCA AGAGACCAGC TCAGCAACAG AGAGAAGTGC TTCTCTTTCT
26401  GGAATGCCCA CTGGTGCTAC TACTAAGGTC TCCAGAACAG AAGCCCTCTC
26451  CTTAGGCAGA ACATCCACCC CAGGTCCTGC TCAATCCACA ATATCACCAG
26501  AAATCTCCAC GGAAACCATC ACTAGAATTT CTACTCCCCT CACCACGACA
26551  GGATCAGCAG AAATGACCAT CACCCCCAAA ACAGGTCATT CTGGGGCATC
26601  CTCACAAGGT ACCTTTACCT TGGACACATC AAGCAGAGCC TCCTGGCCAG
26651  GAACTCACTC AGCTGCAACT CACAGATCTC CACACTCAGG GATGACCACT
26701  CCTATGAGCA GAGGTCCTGA GGATGTGTCA TGGCCAAGCC GCCCATCAGT
26751  GGAAAAAACT AGCCCTCCAT CTTCCCTGGT GTCTTTATCT GCAGTAACCT
26801  CACCTTCGCC ACTTTATTCC ACACCATCTG AGAGTAGCCA CTCATCTCCT
26851  CTCCGGGTGA CTTCTCTTTT CACCCCTGTC ATGATGAAGA CCACAGACAT
26901  GTTGGACACA AGCTTGGAAC CTGTGACCAC TTCACCTCCC AGTATGAATA
26951  TCACCTCAGA TGAGAGTCTG GCCACTTCTA AAGCCACCAT GGAGACAGAG
27001  GCAATTCAGC TTTCAGAAAA CACAGCTGTG ACTCAGATGG CACCATCAG
27051  CGCTAGACAA GAATTCTATT CCTCTTATCC AGGCCTCCCA GAGCCATCCA
27101  AAGTGACATC TCCAGTGGTC ACCTCTTCCA CCATAAAAGA CATTGTTTCT
```

TABLE 24-continued

DNA Sequence of the CA125 Amino Terminal Extension
(SEQ ID NO: 309)

| | |
|---|---|
| 27151 | ACAACCATAC CTGCTTCCTC TGAGATAACA AGAATTGAGA TGGAGTCAAC |
| 27201 | ATCCACCCTG ACCCCCACAC CAAGGGAGAC CAGCACCTCC CAGGAGATCC |
| 27251 | ACTCAGCCAC AAAGCCAAGC ACTGTTCCTT ACAAGGCACT CACTAGTGCC |
| 27301 | ACGATTGAGG ACTCCATGAC ACAAGTCATG TCCTCTAGCA GAGGACCTAG |
| 27351 | CCCTGATCAG TCCACAATGT CACAAGACAT ATCCAGTGAA GTGATCACCA |
| 27401 | GGCTCTCTAC CTCCCCCATC AAGGCAGAAT CTACAGAAAT GACCATTACC |
| 27451 | ACCCAAACAG GTTCTCCTGG GGCTACATCA AGGGGTACCC TTACCTTGGA |
| 27501 | CACTTCAACA ACTTTTATGT CAGGGACCCA CTCAACTGCA TCTCAAGGAT |
| 27551 | TTTCACACTC ACAGATGACC GCTCTTATGA GTAGAACTCC TGGAGATGTG |
| 27601 | CCATGGCTAA GCCATCCCTC TGTGGAAGAA GCCAGCTCTG CCTCTTTCTC |
| 27651 | ACTGTCTTCA CCTGTCATGA CCTCATCTTC TCCCGTTTCT TCCACATTAC |
| 27701 | CAGACAGCAT CCACTCTTCT TCGCTTCCTG TGACATCACT TCTCACCTCA |
| 27751 | GGGCTGGTGA AGACCACAGA GCTGTTGGGC ACAAGCTCAG AACCTGAAAC |
| 27801 | CAGTTCACCC CCAAATTTGA GCAGCACCTC AGCTGAAATA CTGGCCACCA |
| 27851 | CTGAAGTCAC TACAGATACA GAGAAACTGG AGATGACCAA TGTGGTAACC |
| 27901 | TCAGGTTATA CACATGAATC TCCTTCCTCT GTCCTAGCTG ACTCAGTGAC |
| 27951 | AACAAAGGCC ACATCTTCAA TGGGTATCAC CTACCCCACA GGAGATACAA |
| 28001 | ATGTTCTCAC ATCAACCCCT GCCTTCTCTG ACACCAGTAG GATTCAAACA |
| 28051 | AAGTCAAAGC TCTCACTGAC TCCTGGGTTG ATGGAGACCA GCATCTCTGA |
| 28101 | AGAGACCAGC TCTGCCACAG AAAAAGCAC TGTCCTTTCT AGTGTGCCCA |
| 28151 | CTGGTGCTAC TACTGAGGTC TCCAGGACAG AAGCCATCTC TTCTAGCAGA |
| 28201 | ACATCCATCC CAGGCCCTGC TCAATCCACA ATGTCATCAG ACACCTCCAT |
| 28251 | GGAAACCATC ACTAGAATTT CTACCCCCCT CACAAGGAAA GAATCAACAG |
| 28301 | ACATGGCCAT CACCCCCAAA ACAGGTCCTT CTGGGGCTAC CTCGCAGGGT |
| 28351 | ACCTTTACCT TGGACTCATC AAGCACAGCC TCCTGGCCAG GAACTCACTC |
| 28401 | AGCTACAACT CAGAGATTTC CACAGTCAGT GGTGACAACT CCTATGAGCA |
| 28451 | GAGGTCCTGA GGATGTGTCA TGGCCAAGCC CGCTGTCTGT GGAAAAAAAC |
| 28501 | AGCCCTCCAT CTTCCCTGGT ATCTTCATCT TCAGTAACCT CACCTTCGCC |
| 28551 | ACTTTATTCC ACACCATCTG GGAGTAGCCA CTCCTCTCCT GTCCCTGTCA |
| 28601 | CTTCTCTTTT CACCTCTATC ATGATGAAGG CCACAGACAT GTTGGATGCA |
| 28651 | AGTTTGGAAC CTGAGACCAC TTCAGCTCCC AATATGAATA TCACCTCAGA |
| 28701 | TGAGAGTCTG GCCGCTTCTA AAGCCACCAC GGAGACAGAG GCAATTCACG |
| 28751 | TTTTTGAAAA TACAGCAGCG TCCCATGTGG AAACCACCAG TGCTACAGAG |
| 28801 | GAACTCTATT CCTCTTCCCC AGGCTTCTCA GAGCCAACAA AAGTGATATC |
| 28851 | TCCAGTGGTC ACCTCTTCCT CTATAAGAGA CAACATGGTT TCCACAACAA |
| 28901 | TGCCTGGCTC CTCTGGCATT ACAAGGATTG AGATAGAGTC AATGTCATCT |
| 28951 | CTGACCCCTG GACTGAGGGA GACCAGAACC TCCCAGGACA TCACCTCATC |
| 29001 | CACAGAGACA AGCACTGTCC TTTACAAGAT GCCCTCTGGT GCCACTCCTG |
| 29051 | AGGTCTCCAG GACAGAAGTT ATGCCCTCTA GCAGAACATC CATTCCTGGC |

TABLE 24-continued

DNA Sequence of the CA125 Amino Terminal Extension
(SEQ ID NO: 309)

```
29101  CCTGCTCAGT CCACAATGTC ACTAGACATC TCCGATGAAG TTGTCACCAG
29151  GCTGTCTACC TCTCCCATCA TGACAGAATC TGCAGAAATA ACCATCACCA
29201  CCCAAACAGG TTATTCTCTG GCTACATCCC AGGTTACCCT TCCCTTGGGC
29251  ACCTCAATGA CCTTTTTGTC AGGGACCCAC TCAACTATGT CTCAAGGACT
29301  TTCACACTCA GAGATGACCA ATCTTATGAG CAGGGGTCCT GAAAGTCTGT
29351  CATGGACGAG CCCTCGCTTT GTGGAAACAA CTAGATCTTC CTCTTCTCTG
29401  ACATCATTAC CTCTCACGAC CTCACTTTCT CCTGTGTCCT CCACATTACT
29451  AGACAGTAGC CCCTCCTCTC CTCTTCCTGT GACTTCACTT ATCCTCCCAG
29501  GCCTGGTGAA GACTACAGAA GTGTTGGATA CAAGCTCAGA GCCTAAAACC
29551  AGTTCATCTC CAAATTTGAG CAGCACCTCA GTTGAAATAC CGGCCACCTC
29601  TGAAATCATG ACAGATACAG AGAAAATTCA TCCTTCCTCA AACACAGCGG
29651  TGGCCAAAGT GAGGACCTCC AGTTCTGTTC ATGAATCTCA TTCCTCTGTC
29701  CTAGCTGACT CAGAAACAAC CATAACCATA CCTTCAATGG GTATCACCTC
29751  CGCTGTGGAC GATACCACTG TTTTCACATC AAATCCTGCC TTCTCTGAGA
29801  CTAGGAGGAT TCCGACAGAG CCAACATTCT CATTGACTCC TGGATTCAGG
29851  GAGACTAGCA CCTCTGAAGA GACCACCTCA ATCACAGAAA CAAGTGCAGT
29901  CCTTTATGGA GTGCCCACTA GTGCTACTAC TGAAGTCTCC ATGACAGAAA
29951  TCATGTCCTC TAATAGAACA CACATCCCTG ACTCTGATCA GTCCACGATG
30001  TCTCCAGACA TCATCACTGA AGTGATCACC AGGCTCTCTT CCTCATCCAT
30051  GATGTCAGAA TCAACACAAA TGACCATCAC CACCCAAAAA AGTTCTCCTG
30101  GGGCTACAGC ACAGAGTACT CTTACCTTGG CCACAACAAC AGCCCCCTTG
30151  GCAAGGACCC ACTCAACTGT TCCTCCTAGA TTTTTACACT CAGAGATGAC
30201  AACTCTTATG AGTAGGAGTC CTGAAAATCC ATCATGGAAG AGCTCTCCCT
30251  TTGTGGAAAA AACTAGCTCT TCATCTTCTC TGTTGTCCTT ACCTGTCACG
30301  ACCTCACCTT CTGTTTCTTC CACATTACCG CAGAGTATCC CTTCCTCCTC
30351  TTTTTCTGTG ACTTCACTCC TCACCCCAGG CATGGTGAAG ACTACAGACA
30401  CAAGCACAGA ACCTGGAACC AGTTTATCTC CAAATCTGAG TGGCACCTCA
30451  GTTGAAATAC TGGCTGCCTC TGAAGTCACC ACAGATACAG AGAAAATTCA
30501  TCCTTCTTCA AGCATGGCAG TGACCAATGT GGGAACCACC AGTTCTGGAC
30551  ATGAACTATA TTCCTCTGTT TCAATCCACT CGGAGCCATC CAAGGCTACA
30601  TACCCAGTGG GTACTCCCTC TTCCATGGCT GAAACCTCTA TTTCCACATC
30651  AATGCCTGCT AATTTTGAGA CCACAGGATT TGAGGCTGAG CCATTTTCTC
30701  ATTTGACTTC TGGATTTAGG AAGACAAACA TGTCCCTGGA CACCAGCTCA
30751  GTCACACCAA CAAATACACC TTCTTCTCCT GGGTCCACTC ACCTTTTACA
30801  GAGTTCCAAG ACTGATTTCA CCTCTTCTGC AAAAACATCA TCCCCAGACT
30851  GGCCTCCAGC CTCACAGTAT ACTGAAATTC CAGTGGACAT AATCACCCCC
30901  TTTAATGCTT CTCCATCTAT TACGGAGTCC ACTGGGATAA CCTCCTTCCC
30951  AGAATCCAGG TTTACTATGT CTGTAACAGA AAGTACTCAT CATCTGAGTA
```

TABLE 24-continued

DNA Sequence of the CA125 Amino Terminal Extension
(SEQ ID NO: 309)

| | | | | | |
|---|---|---|---|---|---|
| 31001 | CAGATTTGCT | GCCTTCAGCT | GAGACTATTT | CCACTGGCAC | AGTGATGCCT |
| 31051 | TCTCTATCAG | AGGCCATGAC | TTCATTTGCC | ACCACTGGAG | TTCCACGAGC |
| 31101 | CATCTCAGGT | TCAGGTAGTC | CATTCTCTAG | GACAGAGTCA | GGCCCTGGGG |
| 31151 | ATGCTACTCT | GTCCACCATT | GCAGAGAGCC | TGCCTTCATC | CACTCCTGTG |
| 31201 | CCATTCTCCT | CTTCAACCTT | CACTACCACT | GATTCTTCAA | CCATCCCAGC |
| 31251 | CCTCCATGAG | ATAACTTCCT | CTTCAGCTAC | CCCATATAGA | GTGGACACCA |
| 31301 | GTCTTGGGAC | AGAGAGCAGC | ACTACTGAAG | GACGCTTGGT | TATGGTCAGT |
| 31351 | ACTTTGGACA | CTTCAAGCCA | ACCAGGCAGG | ACATCTTCAA | CACCCATTTT |
| 31401 | GGATACCAGA | ATGACAGAGA | GCGTTGAGCT | GGGAACAGTG | ACAAGTGCTT |
| 31451 | ATCAAGTTCC | TTCACTCTCA | ACACGGTTGA | CAAGAACTGA | TGGCATT |

TABLE 25

Amino Terminal Extension of the CA125 Gene (Protein Sequence)
(SEQ ID NO: 310)

| | | | | | |
|---|---|---|---|---|---|
| 1 | MLKPSGLPGS | SSPTRSLMTG | SRSTKATPEM | DSGLTGATLS | PKTSTGAIVV |
| 51 | TEHTLPFTSP | DKTLASPTSS | VVGRTTQSLG | VMSSALPEST | SRGMTHSEQR |
| 101 | TSPSLSPQVN | GTPSRNYPAT | SMVSGLSSPR | TRTSSTEGNF | TKEASTYTLT |
| 151 | VETTSGPVTE | KYTVPTETST | TEGDSTETPW | DTRYIPVKIT | SPMKTFADST |
| 201 | ASKENAPVSM | TPAETTVTDS | HTPGRTNPSF | GTLYSSFLDL | SPKGTPNSRG |
| 251 | ETSLELILST | TGYPFSSPEP | GSAGHSRIST | SAPLSSSASV | LDNKISETSI |
| 301 | FSGQSLTSPL | SPGVPEARAS | TMPNSAIPFS | MTLSNAETSA | ERVRSTISSL |
| 351 | GTPSISTKQT | AETILTFHAF | AETMDIPSTH | IAKTLASEWL | GSPGTLGGTS |
| 401 | TSALTTTSPS | TTLVSEETNT | HHSTSGKETE | GTLNTSMTPL | ETSAPGEESE |
| 451 | MTATLVPTLG | FTTLDSKIRS | PSQVSSSHPT | RELRTTGSTS | GRQSSSTAAH |
| 501 | GSSDILRATT | SSTSKASSWT | SESTAQQFSE | PQHTQWVETS | PSMKTERPPA |
| 551 | STSVAAPITT | SVPSVVSGFT | TLKTSSTKGI | WLEETSADTL | IGESTAGPTT |
| 601 | HQFAVPTGIS | MTGGSSTRGS | QGTTHLLTRA | TASSETSADL | TLATNGVPVS |
| 651 | VSPAVSKTAA | GSSPPGGTKP | SYTMVSSVIP | ETSSLQSSAF | REGTSLGLTP |
| 701 | LNTRHPFSSP | EPDSAGHTKI | STSIPLLSSA | SVLEDKVSAT | STFSHHKATS |
| 751 | SITTGTPEIS | TKTKPSSAVL | SSMTLSNAAT | SPERVRNATS | PLTHPSPSGE |
| 801 | ETAGSVLTLS | TSAETTDSPN | IHPTGTLTSE | SSESPSTLSL | PSVSGVKTTF |
| 851 | SSSTPSTHLF | TSGEETEETS | NPSVSQPETS | VSRVRTTLAS | TSVPTPVFPT |
| 901 | MDTWPTRSAQ | FSSSHLVSEL | RATSSTSVTN | STGSALPKIS | HLTGTATMSQ |
| 951 | TNRDTFNDSA | APQSTTWPET | SPRFKTGLPS | ATTTVSTSAT | SLSATVMVSK |
| 1001 | FTSPATSSME | ATSIREPSTT | ILTTETTNGP | GSMAVASTNI | PIGKGYITEG |
| 1051 | RLDTSHLPIG | TTASSETSMD | FTMAKESVSM | SVSPSQSMDA | AGSSTPGRTS |
| 1101 | QFVDTFSDDV | YHLTSREITI | PRDGTSSALT | PQMTATHPPS | PDPGSARSTW |
| 1151 | LGILSSSPSS | PTPKVTMSST | FSTQRVTTSM | IMDTVETSRW | NMPNLPSTTS |
| 1201 | LTPSNIPTSG | AIGKSTLVPL | DTPSPATSLE | ASEGGLPTLS | TYPESTNTPS |

TABLE 25-continued

Amino Terminal Extension of the CA125 Gene (Protein Sequence)
(SEQ ID NO: 310)

```
1251  IHLGAHASSE  SPSTINLTMA  SVVKPGSYTP  LTFPSIETHI  HVSTARMAYS
1301  SGSSPEMTAP  GETNTGSTWD  PTTYITTTDP  KDTSSAQVST  PHSVRTLRTT
1351  ENHPKTESAT  PAAYSGSPKI  SSSPNLTSPA  TKAWTITDTT  EHSTQLHYTK
1401  LAEKSSGFET  QSAPGPVSVV  IPTSPTIGSS  TLELTSDVPG  EPLVLAPSEQ
1451  TTITLPMATW  LSTSLTEEMA  STDLDISSPS  SPMSTFAIFP  PMSTPSHELS
1501  KSEADTSAIR  NTDSTTLDQH  LGIRSLGRTG  DLTTVPITPL  TTTWTSVIEH
1551  STQAQDTLSA  TMSPTHVTQS  LKDQTSIPAS  ASPSHLTEVY  PELGTQGRSS
1601  SEATTFWKPS  TDTLSREIET  GPTNIQSTPP  MDNTTTGSSS  SGVTLGIAHL
1651  PIGTSSPAET  STNMALERRS  STATVSMAGT  MGLLVTSAPG  RSISQSLGRV
1701  SSVLSESTTE  GVTDSSKGSS  PRLNTQGNTA  LSSSLEPSYA  EGSQMSTSIP
1751  LTSSPTTPDV  EFIGGSTFWT  KEVTTVMTSD  ISKSSARTES  SSATLMSTAL
1801  GSTENTGKEK  LRTASMDLPS  PTPSMEVTPW  ISLTLSNAPN  TTDSLDLSHG
1851  VHTSSAGTLA  TDRSLNTGVT  RASRLENGSD  TSSKSLSMGN  STHTSMTDTE
1901  KSEVSSSIHP  RPETSAPGAE  TTLTSTPGNR  AISLTLPFSS  IPVEEVISTG
1951  ITSGPDINSA  PMTHSPITPP  TIVWTSTGTI  EQSTQPLHAV  SSEKVSVQTQ
2001  STPYVNSVAV  SASPTHENSV  SSGSSTSSPY  SSASLESLDS  TISRRNAITS
2051  WLWDLTTSLP  TTTWPSTSLS  EALSSGHSGV  SNPSSTTTEF  PLFSAASTSA
2101  AKQRNPETET  HGPQNTAAST  LNTDASSVTG  LSETPVGASI  SSEVPLPMAI
2151  TSRSDVSGLT  SESTANPSLG  TASSAGTKLT  RTISLPTSES  LVSFRMNKDP
2201  WTVSIPLGSH  PTTNTETSIP  VNSAGPPGLS  TVASDVIDTP  SDGAESIPTV
2251  SFSPSPDTEV  TTISHFPEKT  THSFRTISSL  THELTSRVTP  IPGDWMSSAM
2301  STKPTGASPS  ITLGERRTIT  SAAPTTSPIV  LTASFTETST  VSLDNETTVK
2351  TSDILDARKT  NELPSDSSSS  SDLINTSIAS  STMDVTKTAS  ISPTSISGMT
2401  ASSSPSLFSS  DRPQVPTSTT  ETNTATSPSV  SSNTYSLDGG  SNVGGTPSTL
2451  PPFTITHPVE  TSSALLAWSR  PVRTFSTMVS  TDTASGENPT  SSNSVVTSVP
2501  APGTWTSVGS  TTDLPAMGFL  KTSPAGEAHS  LLASTIEPAT  AFTPHLSAAV
2551  VTGSSATSEA  SLLTTSESKA  IHSSPQTPTT  PTSGANWETS  ATPESLLVVT
2601  ETSDTTLTSK  ILVTDTILFS  TVSTPPSKFP  STGTLSGASF  PTLLPDTPAI
2651  PLTATEPTSS  LATSFDSTPL  VTIASDSLGT  VPETTLTMSE  TSNGDALVLK
2701  TVSNPDRSIP  GITIQGVTES  PLHPSSTSPS  KIVAPRNTTY  EGSITVALST
2751  LPAGTTGSLV  FSQSSENSET  TALVDSSAGL  ERASVMPLTT  GSQGMASSGG
2801  IRSGSTHSTG  TKTFSSLPLT  MNPGEVTAMS  EITTNRLTAT  QSTAPKGIPV
2851  KPTSAESGLL  TPVSASSSPS  KAFASLTTAP  PTWGIPQSTL  TFEFSEVPSL
2901  DTKSASLPTP  GQSLNTIPDS  DASTASSSLS  KSPEKNPRAR  MMTSTKAISA
2951  SSFQSTGFTE  TPEGSASPSM  AGHEPRVPTS  GTGDPRYASE  SMSYPDPSKA
3001  SSAMTSTSLA  SKLTTLFSTG  QAARSGSSSS  PISLSTEKET  SFLSPTASTS
3051  RKTSLFLGPS  MARQPNILVH  LQTSALTLSP  TSTLNMSQEE  PPELTSSQTI
3101  AEEEGTTAET  QTLTFTPSET  PTSLLPVSSP  TEPTARRKSS  PETWASSISV
```

TABLE 25-continued

Amino Terminal Extension of the CA125 Gene (Protein Sequence)
(SEQ ID NO: 310)

Contig 27

```
3151  PAKTSLVETT DGTLVTTIKM SSQAAQGNST QPAPAEETGT SPAGTSPGSP

3201  EMSTTLKIMS SKEPSISPEI RSTVRNSPWK TPETTVPMET TVEPVTLQST

3251  ALGSGSTSIS HLPTGTTSPT KSPTENMLAT ERVSLSPSPP EAWTNLYSGT

3301  PGGTRQSLAT MSSVSLESPT ARSITGTGQQ SSPELVSKTT GMEFSMWHGS

3351  TGGTTGDTHV SLSTSSNILE DPVTSPNSVS SLTDKSKHKT ETWVSTTAIP

3401  STVLNNKIMA AEQQTSRSVD EAYSSTSSWS DQTSGSDITL GASPDVTNTL

3451  YITSTAQTTS LVSLPSGDQG ITSLTNPSGG KTSSASSVTS PSIGLETLRA

3501  NVSAVKSDIA PTAGHLSQTS SPAEVSILDV TTAPTPGIST TITTMGTNSI

3551  STTTPNPEVG MSTMDSTPAT ERRTTSTEHP STWSSTAASD SWTVTDMTSN

3601  LKVARSPGTI STMHTTSFLA SSTELDSMST PHGRITVIGT SLVTPSSDAS

3651  AVKTETSTSE RTLSPSDTTA STPISTFSRV QRMSISVPDI LSTSWTPSST

3701  EAEDVPVSMV PTDHASTKTD PNTPLSTFLF DSLSTLDWDT GRSLSSATAT

3751  TSAPQGATTP QELTLETMIS PATSQLPFSI GHITSAVTPA AMARSSGVTF

3801  SRPDPTSKKA EQTSTQLPTT TSAHPGQVPR SAATTLDVIP HTAKTPDATF

3851  QRQGQTALTT EARATSDSWN EKEKSTPSAP WITEMMNSVS EDTIKEVTSS

3901  SSVLKDPEYA GHKLGIWDDF IPKFGKAAHM RELPLLSPPQ DKEAIHPSTN

3951  TVETTGWVTS SEHASHSTIP AHSASSKLTS PVVTTSTREQ AIVSMSTTTW

4001  PESTRARTEP NSFLTIELRD VSPYMDTSST TQTSIISSPG STAITKGHRT

4051  EITSYKRISS SFLAQSMRSS DSPSEAITRL SNFPAMTESG GMILAMQTSP

4101  PGATSISAPT LDTSATASWT GTPLATTQRF TYSEKTTLFS KGREDTSQPS

4151  PPCVEETSSS SSVVPIHATT SPSNILLTSQ GHSPSSTPPV TSVFLSETSG

4201  LGKTTDMSRI SLEPGTSLPP NLSSTAGEAL STYEASRDTK AIHHSADTAV

4251  TNMEATSSEY SPIPGHTKPS KATSPLVTSH IMGDITSSTS VFGSSETTEI

4301  ETVSSVNQGL QERSTSQVAS SATETSTVIT HVSSGDATTH VTKTQATFSS

4351  GTSISSPHQF ITSTNTFTDV STNPSTSLIM TESSGVTITT QTGPTGAATQ

4401  GPYLLDTSTM PYLTETPLAV TPDFMQSEKT TLISKGPKDV TWTSPPSVAE

4451  TSYPSSLTPF LVTTIPPATS TLQGQHTSSP VSATSVLTSG LVKTTDMLNT

4501  SMEPVTNSPQ NLNNPSNEIL ATLAATTDIE TIHPSINKAV TNMGTASSAH

4551  VLHSTLPVSS EPSTATSPMV PASSMGDALA SISIPGSETT DIEGEPTSSL

4601  TAGRKENSTL QEMNSTTESN IILSNVSVGA ITEATKMEVP SFDATFIPTP

4651  AQSTKFPDIF SVASSRLSNS PPMTISTHMT TTQTGSSGAT SKIPLALDTS

4701  TLETSAGTPS VVTEGFAHSK ITTAMNNDVK DVSQTNPPFQ DEASSPSSQA

4751  PVLVTTLPSS VAFTPQWHST SSPVSMSSVL TSSLVKTAGK VDTSLETVTS

4801  SPQSMSNTLD DISVTSAATT DIETTHPSIN TVVTNVGTTG SAFESHSTVS

4851  AYPEPSKSHI LPMLPPPPWK TPQFPRSIPK SSKTTRTETE TTSSLTPKLR

4901  ETSISQEITS STETSTVPYK ELTGATTEVS RTDVTSSSST SFPGPDQSTV

4951  SLDISTETNT RLSTSPIMTE SAEITITTQT GPHGATSQDT FTMDPSNTTP

5001  QAGIHSAMTH GFSQLDVTTL MSRIPQDVSW TSPPSVDKTS SPSSFLSSPA
```

TABLE 25-continued

Amino Terminal Extension of the CA125 Gene (Protein Sequence)
(SEQ ID NO: 310)

```
5051  MTTPSLISST  LPEDKLSSPM  TSLLTSGLVK  ITDILRTRLE  PVTSSLPNFS

5101  STSDKILATS  KDSKDTKEIF  PSINTEETNV  KANNSGHESH  SPALADSETP

5151  KATTQMVITT  TVGDPAPSTS  MPVHGSSETT  NIKREPTYFL  TPRLRETSTS

5201  QESSFPTDTS  FLLSKVPTGT  ITEVSSTGVI  SSSKISTPDH  DKSTVPPDTF

5251  TGEIPRVFTS  SIKTKSAEMT  ITTQASPPES  ASHSTLPLDT  STTLSQGGTH

5301  STVSQGFPYS  EVTTLMGMGP  GNVSWMTTPP  VEETSSVSSL  MSSPAMTSPS

5351  PVSSTSPQSI  PSSPLPVTAL  PTSVLVTTTD  VLGTTSPESV  TSSPPNLSSI

5401  THERPATYKD  TABTEAAMHH  STNTAVTNVG  TSGSGHKSQS  SVLADSETSK

5451  ATPLMSTAST  LGDTSVSTST  PNISQTNQIQ  TEPTASLSPR  LRESSTSEKT

5501  SSTTETNTAF  SYVPTGAITQ  ASRTEISSSR  TSISDLDRST  IAPDISTGMI

5551  TRLFTSPIMT  KSAEMTVTTQ  TTTPGATSQG  ILPWDTSTTL  FQGGTHSTVS

5601  QGFPHSEITT  LRSRTPGDVS  WMTTPPVEET  SSGFSLMSPS  MTSPSPVSST

5651  SPESIPSSPL  PVTALLTSVL  VTTTNVLGTT  SPEPVTSSPP  NLSSPTQERL

5701  TTYKDTAHTE  AMHASMHTNT  AVANVGTSIS  GHESQSSVPA  DSHTSKATSP

5751  MGITFAMGDT  SVYTSTPAFF  ETRIQSESTS  SLIPGLRDTR  TSEEINTVTE

5801  TSTVLSEVPT  TTTTEVSRTE  VITSSRTTIS  GPDHSKMSPY  ISTETITRLS

5851  TFPFVTGSTE  MAITNQTGPI  GTISQATLTL  DTSSTASWEG  THSPVTQRFP

5901  HSEETTTMSR  STKGVSWQSP  PSVEETSSPS  SPVPLPAITS  HSSLYSAVSG

5951  SSPTSALPVT  SLLTSGRRKT  IDMLDTHSEL  VTSSLPSASS  FSGEILTSEA

6001  STNTETIHFS  ENTAETNMGT  TNSMHKLHSS  VSIHSQPSGH  TPPKVTGSMM

6051  EDAIVSTSTP  GSPETKNVDR  DSTSPLTPEL  KEDSTALVMN  STTESNTVFS

6101  SVSLDAATEV  SRAEVTYYDP  TFMPASAQST  KSPDISPEAS  SSHSNSPPLT

6151  ISTHKTIATQ  TGPSGVTSLG  QLTLDTSTIA  TSAGTPSART  QDFVDSETTS

6201  VMNNDLNDVL  KTSPFSAEEA  NSLSSQAPLL  VTTSPSPVTS  TLQEHSTSSL

6251  VSVTSVPTPT  LAKITDMDTN  LEPVTRSPQN  LRNTLATSEA  TTDTHTMHPS

6301  INTAMANVGT  TSSPNEFYFT  VSPDSDPYKA  TSAVVITSTS  GDSIVSTSMP

6351  RSSAMKKIES  ETTFSLIFRL  RETSTSQKIG  SSSDTSTVFD  KAFTAATTEV

Contig16
6401  SRTELTSSSR  TSIQGTEKPT  MSPDTSTRSV  TMLSTFAGLT  KSEERTIATQ

6451  TGPHRATSQG  TLTWDTSITT  SQAGTHSAMT  HGFSQLDLST  LTSRVPEYIS

6501  GTSPPSVEKT  SSSSSLLSLP  AITSPSPVPT  TLPESRPSSP  VHLTSLPTSG

6551  LVKTTDMLAS  VASLPPNLGS  TSHKIPTTSE  DIKDTEKMYP  STNIAVTNVG

6601  TTTSEKESYS  SVPAYSEPPK  VTSPMVTSFN  IRDTIVSTSM  PGSSEITRIE

6651  MESTFSLAHG  LKGTSTSQDP  IVSTEKSAVL  HKLTTGATET  SRTEVASSRR

6701  TSIPGPDHST  ESPDISTEVI  PSLPISLGIT  ESSNMTIITR  TGPPLGSTSQ

6751  GTFTLDTPTT  SSRAGTHSMA  TQEFPHSEMT  TVMNKDPEIL  SWTIPPSIEK

6801  TSFSSSLMPS  PAMTSPPVSS  TLPKTIHTTP  SPMTSLLTPS  LVMTTDTLGT

6851  SPEPTTSSPP  NLSSTSHEIL  TTDEDTTAIE  AMHPSTSTAA  TNVETTSSGH

6901  GSQSSVLADS  EKTKATAPMD  TTSTMGHTTV  STSMSVSSET  TKIKRESTYS
```

TABLE 25-continued

Amino Terminal Extension of the CA125 Gene (Protein Sequence)
(SEQ ID NO: 310)

```
6951 LTPGLRETSI SQNASFSTDT SIVLSEVPTG TTAEVSRTEV TSSGRTSIPG

7001 PSQSTVLPEI STRTMTRLFA SPTMTESAEM TIPTQTGPSG STSQDTLTLD

7051 TSTTKSQAKT HSTLTQRFPH SEMTTLMSRG PGDMSWQSSP SLENPSSLPS

7101 LLSLPATTSP PPISSTLPVT ISSSPLPVTS LLTSSPVTTT DMLHTSPELV

7151 TSSPPKLSHT SDERLTTGKD TTNTEAVHPS TNTAASNVEI PSSGHESPSS

7201 ALADSETSKA TSPMFITSTQ EDTTVAISTP HFLETSRIQK ESISSLSPKL

Contig10
7251 RETGSSVETS SAIETSAVLS EVSVGATTEI SRTEVTSSSR TSISGSAIST

7301 MLPEISTTRK IIKFPTSPIL AISSEMTIKT QTSPPGSTSE STFTLDTSTT

7351 PSLVITHSTM TQRLPHSEIT TLVSRGAGDV PRPSSLPVEE TSPPSSQLSL

7401 SAMISPSPVS STLPASSHSS SASVTSLLTP GQVKTTEVLD ASAEPETSSP

7451 PSLSSTSVEI LATSEVTTDT EKIHPFSNTA VTKVGTSSSG HESPSSVLPD

7501 SETTKATSAM GTISIMGDTS VSTLTPALSM TRKIQSEPAS SLTTRLRETS

7551 TSEETSLATE ANTVLSKVST GATTEVSRTE AISFSRTSMS GPEQSTMSQD

7601 ISIGTIPRIS ASSVLTESAK MTITTQTGPS ESTLESTLNL NTATTPSWVE

7651 THSIVIQGFP HPEMTTSMGR GPGGVSWPSP PFVKETSPPS SPLSLPAVTS

Contig22
7701 PHPVSTTFLA HIPPSPLPVT SLLTSGPATT TDILGTSTEP GTSSSSSLST

7751 TSHERLTTYK DTAHTEAVHP STNTGGTNVA TTSSGYKSQS SVLADSSPMC

7801 TTSTMGDTSV LTSTPAFLET RRIQTELASS LTPGLRESSG SEGTSSGTKM

7851 STVLSKVPTG ATTEISKEDV TSIPGPAQST ISPDTSTRTV SWFSTSPVMT

7901 ESAEITMNTH TSPLGATTQG TSTLDTSSTT SLTMTHSTIS QGFSHSQMST

7951 LMRRGPEDVS WMSPPLLEKT RPSFSLMSSP ATTSPSPVSS TLPESISSSP

8001 LPVTSLLTSG LAKTTDMLHK SSEPVTNSPA NLSSTSVEIL ATSEVTTDTE

8051 KTHPSSNRTV TDVGTSSSGH ESTSFVLADS QTSKVTSPMV ITSTMEDTSV

8101 STSTPGFFET SRIQTEPTSS LTLGLRKTSS SEGTSLATEM STVLSGVPTG

8151 ATAEVSRTEV TSSSRTSISG FAQLTVSPET STETITRLPT SSIMTESAEM

8201 MIKTQTDPPG STPESTHTVD ISTTPNWVET HSTVTQRFSH SEMTTLVSRS

8251 PGDMLWPSQS SVEETSSASS LLSLPATTSP SPVSSTLVED FPSASLPVTS

8301 LLTPGLVITT DRMGISREPG TSSTSNLSST SHERLTTLED TVDTEAMQPS

8351 THTAVTNVRT SISGHESQSS VLSDSETPKA TSSMGTTYTM GETSVSISTS

8401 DFFETSRVQI EPTSSLTSGL RETSSSERIS SATEGSTVLS EVPSGATTEV

8451 SRTEVISSRG TSMSGPDQFT ISPDISTEAI TRLSTSPIMT ESAESAITIE

8501 TGSPGATSEG TLTLDTSTTT FWSGTHSTAS PGFSHSEMTT LMSRTPGDVP

8551 WPSLPSVEEA SSVSSSLSSP AMTSTSFFST LPESISSSPH PVTALLTLGP

8601 VKTTDMLRTS SEPETSSPPN LSSTSAEILA TSEVTKDREK IHPSSNTPVV

8651 NVGTVIYKHL SPSSVLADLV TTKPTSPMAT TSTLGNTSVS TSTPAFPETM

8701 MTQPTSSLTS GLREISTSQE TSSATERSAS LSGMPTGATT KVSRTEALSL

8751 GRTSTPGPAQ STISPEISTE TITRISTPLT TTGSAEMTIT PKTGHSGASS

8801 QGTFTLDTSS RASWPGTHSA ATHRSPHSGM TTPMSRGPED VSWPSRPSVE
```

TABLE 25-continued

Amino Terminal Extension of the CA125 Gene (Protein Sequence)
(SEQ ID NO: 310)

```
8851   KTSPPSSLVS LSAVTSPSPL YSTPSESSHS SPLRVTSLFT PVMMKTTDML

8901   DTSLEPVTTS PPSMNITSDE SLATSKATME TEAIQLSENT AVTQMGTISA

8951   RQEFYSSYPG LPEPSKVTSP VVTSSTIKDI VSTTIPASSE ITRIEMESTS

9001   TLTPTPRETS TSQEIHSATK PSTVPYKALT SATIEDSMTQ VMSSSRGPSP

9051   DQSTMSQDIS TEVITRLSTS PIKAESTEMT ITTQTGSPGA TSRGTLTLDT

9101   STTFMSGTHS TASQGFSHSQ MTALMSRTPG DVPWLSHPSV EEASSASFSL

9151   SSPVMTSSSP VSSTLPDSIH SSSLPVTSLL TSGLVKTTEL LGTSSEPETS

9201   SPPNLSSTSA EILATTEVTT DTEKLEMTNV VTSGYTHESP SSVLADSVTT

9251   KATSSMGITY PTGDTNVLTS TPAFSDTSRI QTKSKLSLTP GLMETSISEE
                      Contig 36
9301   TSSATEKSTV LSSVPTGATT EVSRTEAISS SRTSIPGPAQ STMSSDTSME

9351   TITRISTPLT RKESTDMAIT PKTGPSGATS QGTFTLDSSS TASWPGTHSA

9401   TTQRFPQSVV TTPMSRGPED VSWPSPLSVE KNSPPSSLVS SSSVTSPSPL

9451   YSTPSGSSHS SPVPVTSLFT SIMMKATDML DASLEPETTS APNMNITSDE

9501   SLAASKATTE TEAIHVFENT AASHVETTSA TEELYSSSPG FSEPTKVISP

9551   VVTSSSIRDN MVSTTMPGSS GITRIEIESM SSLTPGLRET RTSQDITSST

9601   ETSTVLYKMP SGATPEVSRT EVMPSSRTSI PGPAQSTMSL DISDEVVTRL

9651   STSPIMTESA EITITTQTGY SLATSQVTLP LGTSMTFLSG THSTMSQGLS

9701   HSEMTNLMSR GPESLSWTSP RFVETTRSSS SLTSLPLTTS LSPVSSTLLD

9751   SSPSSPLPVT SLILPGLVKT TEVLDTSSEP KTSSSPNLSS TSVEIPATSE

9801   IMTDTEKIHP SSNTAVAKVR TSSSVHESHS SVLADSETTI TIPSMGITSA

9851   VDDTTVFTSN PAFSETRRIP TEPTFSLTPG FRETSTSEET TSITETSAVL

9901   YGVPTSATTE VSMTEIMSSN RIHIPDSDQS TMSPDIITEV ITRLSSSSMM

9951   SESTQMTITT QKSSPGATAQ STLTWPQQQP PWQGPTQLFL LDFYTSEMTT

10001  LMSRSPENPS WKSSLFVEKT SSSSSLLSLP VTTSPSVSST LPQSIPSSSF

10051  SVTSLLTPGM VKTTDTSTEP GTSLSPNLSG TSVEILAASE VTTDTEKIHP

10101  SSSMAVTNVG TTSSGHELYS SVSIHSEPSK ATYPVGTPSS MAETSISTSM

10151  PANFETTGFE AEPFSHLTSG FRKTNMSLDT SSVTPTNTPS SPGSTHLLQS

10201  SKTDFTSSAK TSSPDWPPAS QYTEIPVDII TPFNASPSIT ESTGITSFPE

10251  SRFTMSVTES THHLSTDLLP SAETISTGTV MPSLSEAMTS FATTGVPRAI

10301  SGSGSPFSRT ESGPGDATLS TIAESLPSST PVPFSSSTFT TTDSSTIPAL

10351  HEITSSSATP YRVDTSLGTE SSTTEGRLVM VSTLDTSSQP GRTSSTPILD

10401  TRMTESVELG TVTSAYQVPS LSTRLTRTDG I
```

TABLE 26

Serine/Threonine O-Glycosylation Pattern for the
CA125 Amino Terminal Extension
(SEQ ID NO: 310)

contig62

```
          o    oo          o                o
   1  MLKPSGLPGS SSPTRSLMGG SRSTKATPEM DSGLTGATLS PKTSTGAIVV o              o              o   o  o
  51  TEHTLPFTSP DKTLASPTSS VVGRTTQSLG VMSSALPEST SRGMTHSEQR o o       o           oo       oo  x       o
 101  TSPSLSPQVN GTPSRNYPAT SMVSGLSSPR TRTSSTEGNF TKEASTYTLT oo    o     o ooo o   oo              o
 151  VETTSGPVTE KYTVPTETST TEGDSTETPW DTRYIPVKIT SPMKTFADST o           oo      o   o    o
 201  ASKENAPVSM TPAETTVTDS HTPGRTNPSF GTLYSSFLDL SPKGTPNSRG o     o        o  oo
 251  ETSLELILST TGYPFSSPEP GSAGHSRIST SAPLSSSASV LDNKISETSI o  o  o                                      o  o
 301  FSGQSLTSPL SPGVPEARAS TMPNSAIPFS MTLSNAETSA ERVRSTISSL o o                                             o
 351  GTPSISTKQT AETILTFHAF AETMDIPSTH IAKTLASEWL GSPGTLGGTS oo  oooo o oo  o       o          x         oo
 401  TSALTTTSPS TTLVSEETNT HHSTSGKETE GTLNTSMTPL ETSAPGEESE o            o  o   o     o o    o oo
 451  MTATLVPTLG FTTLDSKIRS PSQVSSSHPT RELRTTGSTS GRQSSSTAAH o    ooo  oo o o    o       o      o  o  o
 501  GSSDILRATT SSTSKASSWT SESTAQQFSE PQHTQWVETS PSMKTERPPA ooo    oo                              oo   o
 551  STSVAAPITT SVPSVVSGFT TLKTSSTKGI WLEETSADTL IGESTAGPTT oo           o                    o
 601  HQFAVPTGIS MTGGSSTRGS QGTTHLLLTRA TASSETSADL TLATNGVPVS o o    oo       o o    o
 651  VSPAVSKTAA GSSPPGGTKP SYTMVSSVIP ETSSLQSSAF REGTSLGLTP o    oo           oo                         oo
 701  LNTRHPFSSP EPDSAGHTKI STSIPLLSSA SVLEDKVSAT STFSHHKATS o ooo o  oo   o                x o    o  o o
 751  SITTGTPEIS TKTKPSSAVL SSMTLSNAAT SPERVRNATS PLTHPSPSGE o  oo        o   o   oo o oo      o      o
 801  ETAGSVLTLS TSAETTDSPN IHPTGTLTSE SSESPSTLSL PSVSGVKTTF oooo oo   o      oo    o           o    oo o    o
 851  SSSTPSTHLF TSGEETEETS NPSVSQPETS VSRVRTTLAS TSVPTPVFPT o o        o  oo  ox oo o
 901  MDTWPTRSAQ FSSSHLVSEL RATSSTSVTN STGSALPKIS HLTGTATMSQ x        oo       o    o    o  ooo ooo     o
 951  TNRDTFNDSA APQSTTWPET SPRFKTGLPS ATTTVSTSAT SLSATVMVSK o  o     o    oo     oo  o         o
1001  FTSPATSSME ATSIREPSTT ILTTETTNGP GSMAVASTNI PIGKGYITEG oo                    o   o  o       ooo
1051  RLDTSHLPIG TTASSETSMD FTMAKESVSM SVSPSQSMDA AGSSTPGRTS oo  o      o o   o
1101  QFVDTFSDDV YHLTSREITI PRDGTSSALT PQMTATHPPS PDPGSARSTW ooo oo   o   o ooo    o   o                 oo o
1151  LGILSSSPSS PTPKVTMSST FSTQRVTTSM IMDTVETSRW NMPNLPSTTS o   o       oo       o o o    o       o       oo o
1201  LTPSNIPTSG AIGKSTLVPL DTPSPATSLE ASEGGLPTLS TYPESTNTPS
```

TABLE 26-continued

Serine/Threonine O-Glycosylation Pattern for the
CA125 Amino Terminal Extension
(SEQ ID NO: 310)

```
               o      oo  x
1251  IHLGAHASSE SPSTINLTMA SVVKPGSYTP LTFPSIETHI HVSTARMAYS o  o        o oo   oo oo     o o      o
1301  SGSSPEMTAP GETNTGSTWD PTTYITTTDP KDTSSAQVST PHSVRTLRTT o o o     o o     o  x     o  o
1351  ENHPKTESAT PAAYSGSPKI SSSPNLTSPA TKAWTITDTT EHSTQLHYTK o   o     o  o  o
1401  LAEKSSGFET QSAPGPVSVV IPTSPTIGSS TLELTSDVPG EPLVLAPSEQ o          oo o   oo         oo    o
1451  TTITLPMATW LSTSLTEEMA STDLDISSPS SPMSTFAIFP PMSTPSHELS o  o
1501  KSEADTSAIR NTDSTTLDQH LGIRSLGRTG DLTTVPITPL TTTWTSVIEH o  o  o  oo   o  o
1551  STQAQDTLSA TMSPTHVTQS LKDQTSIPAS ASPSHLTEVY PELGTQGRSS o             o  oo    x oo  o
1601  SEATTFWKPS TDTLSREIET GPTNIQSTPP MDNTTTGSSS SGVTLGIAHL o         o                o
1651  PIGTSSPAET STNMALERRS STATVSMAGT MGLLVTSAPG RSISQSLGRV o   o o          o         oo
1701  SSVLSESTTE GVTDSSKGSS PRLNTQGNTA LSSSLEPSYA EGSQMSTSIP ooo oo              o  o  o   o      o
1751  LTSSPTTPDV EFIGGSTFWT KEVTTVMTSD ISKSSARTES SSATLMSTAL o  o o  o       o  x
1801  GSTENTGKEK LRTASMDLPS PTPSMEVTPW ISLTLSNAPN TTDSLDLSHG o         x          x o
1851  VHTSSAGTLA TDRSLNTGVT RASRLENGSD TSSKSLSMGN STHTSMTDTE o oo      oo       o oo                     o
1901  KSEVSSSIHP RPETSAPGAE TTLTSTPGNR AISLTLPFSS IPVEEVISTG o    o o o o   o       oo       o
1951  ITSGPDINSA PMTHSPITPP TIVWTSTGTI EQSTQPLHAV SSEKVSVQTQ o    o      o oo  oo o  oo
2001  STPYVNSVAV SASPTHENSV SSGSSTSSPY SSASLESLDS TISRRNAITS oo    ooo  o o o   o   o   o ooooo
2051  WLWDLTTSLP TTTWPSTSLS EALSSGHSGV SNPSTTTEF PLFSAASTSA o         o          o   o         oo
2101  AKQRNPETET HGPQNTAAST LNTDASSVTG LSETPVGASI SSEVPLPMAI oo  o       o         o   o
2151  TSRSDVSGLT SESTANPSLG TASSAGTKLT RTISLPTSES LVSFRMNKDP o      o      o      o       o o    o
2201  WTVSIPLGSH PTTNTETSIP VNSAGPPGLS TVASDVIDTP SDGAESIPTV o o o o    oo  o      o       o  o       oo
2251  SFSPSPDTEV TTISHFPEKT THSFRTISSL THELTSRVTP IPGDWMSSAM oo  o   o     o o o   o o o    o     o        x
2301  STKPTGASPS ITLGERRTIT SAAPTTSPIV LTASFTETST VSLDNETTVK x      o    o o    o o o
2351  TSDILDARKT NELPSDSSSS SDLINTSIAS STMDVTKTAS ISPTSISGMT ooo  oo    o oo  o o oo o            o oo
2401  ASSSPSLFSS DRPQVPTSTT ETNTATSPSV SSNTYSLDGG SNVGGTPSTL o                  o     o o    o o    oo
2451  PPFTITHPVE TSSALLAWSR PVRTFSTMVS TDTASGENPT SSNSVVTSVP
```

TABLE 26-continued

Serine/Threonine O-Glycosylation Pattern for the
CA125 Amino Terminal Extension
(SEQ ID NO: 310)

```
                                    o
2501 APGTWTSVGS TTDLPAMGFL KTSPAGEAHS LLASTIEPAT AFTPHLSAAV o    o         o        oo  o oo  oo                    o
2551 VTGSSATSEA SLLTTSESKA IHSSPQTPTT PTSGANWETS ATPESLLVVT o oo  o       o          o        o
2601 ETSDTTLTSK ILVTDTILFS TVSTPPSKFP STGTLSGASF PTLLPDTPAI o o o  o         o    o o          o
2651 PLTATEPTSS LATSFDSTPL VTIASDSLGT VPETTLTMSE TSNGDALVLK o         ooo  o       x         o       o
2701 TVSNPDRSIP GITIQGVTES PLHPSSTSPS KIVAPRNTTY EGSITVALST o
2751 LPAGTTGSLV FSQSSENSET TALVDSSAGL ERASVMPLTT GSQGMASSGG o              o          o        o      o o
2801 IRSGSTHSTG TKTFSSLPLT MNPGEVTAMS EITTNRLTAT QSTAPKGIPV o o o o    oo   o              o
2851 KPTSAESGLL TPVSASSSPS KAFASLTTAP PTWGIPQSTL TFEFSEVPSL o o o        o o   o
2901 DTKSASLPTP GQSLNTIPDS DASTASSSLS KSPEKNPRAR MMTSTKAISA o  o         o    o
2951 SSFQSTGFTE TPEGSASPSM AGHEPRVPTS GTGDPRYASE SMSYPDPSKA ooo                     oo             o o
3001 SSAMTSTSLA SKLTTLFSTG QAARSGSSSS PISLSTEKET SFLSPTASTS o     oo  x         o    o
3051 RKTSLFLGPS MARQPNILVH LQTSALTLSP TSTLNMSQEE PPELTSSQTI o o o o o oo     oo  o               oo
3101 AEEEGTTAET QTLTFTPSET PTSLLPVSSP TEPTARRKSS PETWASSISV o           o          xoo      o o o   oo  o
3151 PAKTSLVETT DGTLVTTIKM SSQAAQGNST QPAPAEETGT SPAGTSPGSP o o         o           oo       o
3201 EMSTTLKIMS SKEPSISPEI RSTVRNSPWK TPETTVPMET TVEPVTLQST oo o       o oo  o   o o      o       o o
3251 ALGSGSTSIS HLPTGTTSPT KSPTENMLAT ERVSLSPSPP EAWTNLYSGT o              o
3301 PGGTRQSLAT MSSVSLESPT ARSITGTGQQ SSPELVSKTT GMEFSMWHGS o                                 o o
3351 TGGTTGDTHV SLSTSSNILE DPVTSPNSVS SLTDKSKHKT ETWVSTTAIP o                       o o
3401 STVLNNKIMA AEQQTSRSVD EAYSSTSSWS DQTSGSDITL GASPDVTNTL o   o                        o   o o
3451 YITSTAQTTS LVSLPSGDQG ITSLTNPSGG KTSSASSVTS PSIGLETLRA x          o    o                 oo  o    oo o  o  o o
3501 NVSAVKSDIA PTAGHLSQTS SPAEVSILDV TTAPTPGIST TITTMGTNSI oooo          oo  oo  o      oooo     oo  oo       o
3551 STTTPNPEVG MSTMDSTPAT ERRTTSTEHP STWSSTAASD SWTVTDMTSN o  oo      o        o                  o o
3601 LKVARSPGTI STMHTTSFLA SSTELDSMST PHGRITVIGT SLVTPSSDAS o  o     o o o oo  oo   o                ooo  o ooo
3651 AVKTETSTSE RTLSPSDTTA STPISTFSRV QRMSISVPDI LSTSWTPSST o         o                               o o
3701 EAEDVPVSMV PTDHASTKTD PNTPLSTFLF DSLSTLDWDT GRSLSSATAT
```

TABLE 26-continued

Serine/Threonine O-Glycosylation Pattern for the
CA125 Amino Terminal Extension
(SEQ ID NO: 310)

```
           oo    oo                            o   o
3751  TSAPQGATTP QELTLETMIS PATSQLPFSI GHITSAVTPA AMARSSGVTF o    oo      ooo    oo oo                       o
3801  SRPDPTSKKA EQTSTQLPTT TSAHPGQVPR SAATTLDVIP HTAKTPDATF o                oo                       o
3851  QRQGQTALTT EARATSDSWN EKEKSTPSAP WITEMMNSVS EDTIKEVTSS oo
3901  SSVLKDPEYA GHKLGIWDDF IPKFGKAAHM RELPLLSPPQ DKEAIHPSTN o  o       oo     o  o       o           o
3951  TVETTGWVTS SEHASHSTIP AHSASSKLTS PVVTTSTREQ AIVSMSTTTW o                     o  o  o oo
4001  PESTRARTEP NSFLTIELRD VSPYMDTSST TQTSIISSPG STAITKGHRT o                          oo
4051  EITSYKRISS SFLAQSMRSS DSPSEAITRL SNFPAMTESG GMILAMQTSP ooo o  o    oooo     o                     o
4101  PGATSISAPT LDTSATASWT GTPLATTQRF TYSEKTTLFS KGREDTSQPS ooo oo    oo        o    o ooo     o   o
4151  PPCVEETSSS SSVVPIHATT SPSNILLTSQ GHSPSSTPPV TSVFLSETSG o    x   o
4201  LGKTTDMSRI SLEPGTSLPP NLSSTAGEAL STYEASRDTK AIHHSADTAV ooo   o         o     o                 o        o
4251  TNMEATSSEY SPIPGHTKPS KATSPLVTSH IMGDITSSTS VFGSSETTEI o   o        o   o        o    o o
4301  ETVSSVNQGL QERSTSQVAS SATETSTVIT HVSSGDATTH VTKTQATFSS oo o                 oo   o o    o oo  o oo   o  o
4351  GTSISSPHQF ITSTNTFTDV STNPSTSLIM TESSGVTITT QTGPTGAATQ ooo     o                      o         o
4401  GPYLLDTSTM PYLTETPLAV TPDFMQSEKT TLISKGPKDV TWTSPPSVAE oo o       oo   oo     ooo     o              x
4451  TSYPSSLTPF LVTTIPPATS TLQGQHTSSP VSATSVLTSG LVKTTDMLNT o                     o       o
4501  SMEPVTNSPQ NLNNPSNEIL ATLAATTDIE TIHPSINKAV TNMGTASSAH oo    oo oo    oo                         o
4551  VLHSTLPVSS EPSTATSPMV PASSMGDALA SISIPGSETT DIEGEPTSSL x         x         x                           o
4601  TAGRKENSTL QEMNSTTESN IILSNVSVGA ITEATKMEVP SFDATFIPTP o        o         o  oo      oo  o  o   o       o
4651  AQSTKFPDIF SVASSRLSNS PPMTISTHMT TTQTGSSGAT SKIPLALDTS o   o   o                     o           oo  o
4701  TLETSAGTPS VVTEGFAHSK ITTAMNNDVK DVSQTNPPFQ DEASSPSSQA o          oo oo    o                           o
4751  PVLVTTLPSS VAFTPQWHST SSPVSMSSVL TSSLVKTAGK VDTSLETVTS o    o    oo           o            oo o
4801  SPQSMSNTLD DISVTSAATT DIETTHPSIN TVVTNVGTTG SAFESHSTVS o   o   o      oooo  o
4851  AYPEPSKSHI LPMLPPPPWK TPQFPRSIPK SSKTTRTETE TTSSLTPKLR oo  oo  oo                 oooooo   o         o
4901  ETSISQEITS STETSTVPYK ELTGATTEVS RTDVTSSSST SFPGPDQSTV o         o   o   o     oo      o         o   o   o
4951  SLDISTETNT RLSTSPIMTE SAEITITTQT GPHGATSQDT FTMDPSNTTP
```

TABLE 26-continued

Serine/Threonine O-Glycosylation Pattern for the
CA125 Amino Terminal Extension
(SEQ ID NO: 310)

```
                                      o    oo o  o  oo
5001  QAGIHSAMTH GFSQLDVTTL MSRIPQDVSW TSPPSVDKTS SPSSFLSSPA oo o   o                                   o  x  o
5051  MTTPSLISST LPEDKLSSPM TSLLTSGLVK ITDILRTRLE PVTSSLPNFS x              o  o
5101  STSDKILATS KDSKDTKEIF PSINTEETNV KANNSGHESH SPALADSETP o   oo o   ooo    oo                      ooo
5151  KATTQMVITT TVGDPAPSTS MPVHGSSETT NIKREPTYFL TPRLRETSTS o  o    o           oo                     oo
5201  QESSFPTDTS FLLSKVPTGT ITEVSSTGVI SSSKISTPDH DKSTVPPDTF o         oo o      o oo        o  o
5251  TGEIPRVFTS SIKTKSAEMT ITTQASPPES ASHSTLPLDT STTLSQGGTH o            x    oo       oo oo    oo   oo o
5301  STVSQGFPYS EVTTLMGMGP GNVSWMTTPP VEETSSVSSL MSSPAMTSPS oooo  o   oo   o    o    o     ooo     ooo  x  oo
5351  PVSSTSPQSI PSSPLPVTAL PTSVLVTTTD VLGTTSPESV TSSPPNLSSI o                                              o
5401  THERPATYKD TAHTEAAMHH STNTAVTNVG TSGSGHKSQS SVLADSETSK o  o     oo oooo   x    o    o  o         ooo  o
5451  ATPLMSTAST LGDTSVSTST PNISQTNQIQ TEPTASLSPR LRESSTSEKT oooo     o       o        o         oo         o
5501  SSTTETNTAF SYVPTGAITQ ASRTEISSSR TSISDLDRST IAPDISTGMI o  o     oo   ooo    o
5551  TRLFTSPIMT KSAEMTVTTQ TTTPGATSQG ILPWDTSTTL FQGGTHSTVS oo      oo  o  oo     o o  ooo
5601  QGFPHSEITT LRSRTPGDVS WMTTPPVEET SSGFSLMSPS MTSPSVSST o  o  oo            oo o      ooo     x  oo
5651  SPESIPSSPL PVTALLTSVL VTTTNVLGTT SPEPVTSSPP NLSSPTQERL o        oo  o
5701  TTYKDTAHTE AMHASMHTNT AVANVGTSIS GHESQSSVPA DSHTSKATSP o             o                    o
5751  MGITFAMGDT SVYTSTPAFF ETRIQSESTS SLIPGLRDTR TSEEINTVTE oo  o   o o oo   o     o  o        o              o
5801  TSTVLSEVPT TTTTEVSRTE VITSSRTTIS GPDHSKMSPY ISTETITRLS ox       o          o  oo         o
5851  TFPFVTGSTE MAITNQTGPI GTISQATLTL DTSSTASWEG THSPVTQRFP o           ooo o  o      o          o
5901  HSEETTTMSR STKGVSWQSP PSVEETSSPS SPVPLPAITS HSSLYSAVSG oo oo                       o
5951  SSPTSALPVT SLLTSGRRKT IDMLDTHSEL VTSSLPSASS FSGEILTSEA o            o
6001  STNTETIHFS ENTAETNMGT TNSMHKLHSS VSIHSQPSGH TPPKVTGSMM oooo                             x   oo
6051  EDAIVSTSTP GSPETKNVDR DSTSPLTPEL KEDSTALVMN STTESNTVFS o                   oo      o    o oo o  o
6101  SVSLDAATEV SRAEVTYYDP TFMPASAQST KSPDISPEAS SSHSNSPPLT o  o           o   oo  o      o
6151  ISTHKTIATQ TGPSGVTSLG QLTLDTSTIA TSAGTPSART QDFVDSETTS o         ooo o  oo        ooo
6201  VMNNDLNDVL KTSPFSAEEA NSLSSQAPLL VTTSPSPVTS TLQEHSTSSL
```

TABLE 26-continued

Serine/Threonine O-Glycosylation Pattern for the
CA125 Amino Terminal Extension
(SEQ ID NO: 310)

```
         o oo  o o              o            o      oo  o
6251 VSVTSVPTPT LAKITDMDTN LEPVTRSPQN LRNTLATSEA TTDTHTMHPS o                           ooo        oo
6301 INTAMANVGT TSSPNEFYFT VSPDSDPYKA TSAVVITSTS GDSIVSTSMP o
6351 RSSAMKKIES ETTFSLIFRL RETSTSQKIG SSSDTSTVFD KAFTAATTEV oo   o     o    o       oo
6401 SRTELTSSSR TSIQGTEKPT MSPDTSTRSV TMLSTFAGLT KSEERTIATQ o         oo  o o                      o      o
6451 TGPHRATSQG TLTWDTSITT SQAGTHSAMT HGFSQLDLST LTSRVPEYIS oo         ooo    o    oo o   o o    o  oo      o  o
6501 GTSPPSVEKT SSSSSLLSLP AITSPSPVPT TLPESRPSSP VHLTSLPTSG o    o
6551 LVKTTDMLAS VASLPPNLGS TSHKIPTTSE DIKDTEKMYP STNIAVTNVG o          o          o         oo
6601 TTTSEKESYS SVPAYSEPPK VTSPMVTSFN IRDTIVSTSM PGSSEITRIE o   o
6651 MESTFSLAHG LKGTSTSQDP IVSTEKSAVL HKLTTGATET SRTEVASSRR oo         oo         oo            x            o    o
6701 TSIPGPDHST ESPDISTEVI PSLPISLGIT ESSNMTIITR TGPPLGSTSQ o oo oo         o                         o
6751 GTFTLDTPTT SSRAGTHSMA TQEFPHSEMT TVMNKDPEIL SWTIPPSIEK o ooo   o    oo    oo o   o  oo   o  oo
6801 TSFSSSLMPS PAMTSPPVSS TLPKTIHTTP SPMTSLLTPS LVMTTDTLGT o    oooo   x ooo            o       o oo   o  ooo
6851 SPEPTTSSPP NLSSTSHEIL TTDEDTTAIE AMHPSTSTAA TNVETTSSGH ooo     oo  ooo    o
6901 GSQSSVLADS EKTKATAPMD TTSTMGHTTV STSMSVSSET TKIKRESTYS o     x         o            o        o   o
6951 LTPGLRETSI SQNASFSTDT SIVLSEVPTG TTAEVSRTEV TSSGRTSIPG oo         oo            o o          o o
7001 PSQSTVLPEI STRTMTRLFA SPTMTESAEM TIPTQTGPSG STSQDTLTLD o  oo                     o                 o
7051 TSTTKSQAKT HSTLTQRFPH SEMTTLMSRG PGDMSWQSSP SLENPSSLPS o   ooo       ooo    o  ooo    oo    oo  o
7101 LLSLPATTSP PPISSTLPVT ISSSPLPVTS LLTSSPVTTT DMLHTSPELV ooo                o    o           o       o
7151 TSSPPKLSHT SDERLTTGKD TTNTEAVHPS TNTAASNVEI PSSGHESPSS o      o          o       o    o
7201 ALADSETSKA TSPMFITSTQ EDTTVAISTP HFLETSRIQK ESISSLSPKL o                 o   o o    oo  o  o   oo
7251 RETGSSVETS SAIETSAVLS EVSVGATTEI SRTEVTSSSR TSISGSAIST o                o   o o    ooo  oo       ooo
7301 MLPEISTTRK IIKFPTSPIL AISSEMTIKT QTSPPGSTSE STFTLDTSTT o     o                                oo        o
7351 PSLVITHSTM TQRLPHSEIT TLVSRGAGDV PRPSSLPVEE TSPPSSQLSL o   o  o o     o   o  o  o              o     ooo
7401 SAMISPSPVS STLPASSHSS SASVTSLLTP GQVKTTEVLD ASAEPETSSP o oo   o    o    o                     oo         oo
7451 PSLSSTSVEI LATSEVTTDT EKIHPFSNTA VTKVGTSSSG HESPSSVLPD
```

TABLE 26-continued

Serine/Threonine O-Glycosylation Pattern for the
CA125 Amino Terminal Extension
(SEQ ID NO: 310)

```
              o              oo    oo                           o
7501 SETTKATSAM GTISIMGDTS VSTLTPALSM TRKIQSEPAS SLTTRLRETS oo   o  o                 o
7551 TSEETSLATE ANTVLSKVST GATTEVSRTE AISFSRTSMS GPEQSTMSQD o              o       oo o     o  o            oo
7601 ISIGTIPRIS ASSVLTESAK MTITTQTGPS ESTLESTLNL NTATTPSWVE o              oo  o o   o     oo
7651 THSIVIQGFP HPEMTTSMGR GPGGVSWPSP PFVKETSPPS SPLSLPAVTS o        o      o oo   o       oo    oooooo oo
7701 PHPVSTTFLA HIPPSPLPVT SLLTSGPATT TDILGTSTEP GTSSSSSLST o         o        oo
7751 TSHERLTTYK DTAHTEAVHP STNTGGTNVA TTSSGYKSQS SVLADSSPMC o o    oo    o o                        o    o
7801 TTSTMGDTSV LTSTPAFLET RRIQTELASS LTPGLRESSG SEGTSSGTKM o    o    o     o       oo       oo     oo  o    o     o
7851 STVLSKVPTG ATTEISKEDV TSIPGPAQST ISPDTSTRTV SWFSTSPVMT o     o   ooooo o     o
7901 ESAEITMNTH TSPLGATTQG TSTLDTSSTT SLTMTHSTIS QGFSHSQMST o o  oo   ooo o  oo      o o
7951 LMRRGPEDVS WMSPPLLEKT RPSFSLMSSP ATTSPSPVSS TLPESISSSP o     o o   x  o        oo  o
8001 LPVTSLLTSG LAKTTDMLHK SSEPVTNSPA NLSSTSVEIL ATSEVTTDTE o    x     oo              o   o      oo    oo
8051 KTHPSSNRTV TDVGTSSSGH ESTSFVLADS QTSKVTSPMV ITSTMEDTSV oooo           o           o         o       oo  o
8101 STSTPGFFET SRIQTEPTSS LTLGLRKTSS SEGTSLATEM STVLSGVPTG o        o o          o      o   o   oo   o
8151 ATAEVSRTEV TSSSRTSISG FAQLTVSPET STETITRLPT SSIMTESAEM o      oo   oo  o    ooo         o
8201 MIKTQTDPPG STPESTHTVD ISTTPNWVET HSTVTQRFSH SEMTTLVSRS o oo    o   ooo  o   o
8251 PGDMLWPSQS SVEETSSASS LLSLPATTSP SPVSSTLVED FPSASLPVTS o      ooo x  o                 o    o
8301 LLTPGLVITT DRMGISREPG TSSTSNLSST SHERLTTLED TVDTEAMQPS o      o      o o           o  oo
8351 THTAVTNVRT SISGHESQSS VLSDSETPKA TSSMGTTYTM GETSVSISTS o                   o     o         o
8401 DFFETSRVQI EPTSSLTSGL RETSSSERIS SATEGSTVLS EVPSGATTEV o      o o     o          o   o   o  o           o
8451 SRTEVISSRG TSMSGPDQFT ISPDISTEAI TRLSTSPIMT ESAESAITIE o o              oo  o       oo  o               o o
8501 TGSPGATSEG TLTLDTSTTT FWSGTHSTAS PGFSHSEMTT LMSRTPGDVP o o o oo   ooo   o      o o
8551 WPSLPSVEEA SSVSSSLSSP AMTSTSFFST LPESISSSPH PVTALLTLGP oo o    ooo x  ooo       o
8601 VKTTDMLRTS SEPETSSPPN LSSTSAEILA TSEVTKDREK IHPSSNTPVV o  o    o oo   xoo o ooo
8651 NVGTVIYKHL SPSSVLADLV TTKPTSPMAT TSTLGNTSVS TSTPAFPETM o  oo   o       oo     o    o o o    o       o
8701 MTQPTSSLTS GLREISTSQE TSSATERSAS LSGMPTGATT KVSRTEALSL
```

TABLE 26-continued

Serine/Threonine O-Glycosylation Pattern for the
CA125 Amino Terminal Extension
(SEQ ID NO: 310)

```
       ooo       oo o        o     o oo     oo o     o o         o
8751  GRTSTPGPAQ STISPEISTE TITRISTPLT TTGSAEMTIT PKTGHSGASS o           o            o
8801  QGTFTLDTSS RASWPGTHSA ATHRSPHSGM TTPMSRGPED VSWPSRPSVE oo   o  o  o oo o    oo o  o   o
8851  KTSPPSSLVS LSAVTSPSPL YSTPSESSHS SPLRVTSLFT PVMMKTTDML o    ooo    x  o      o   o
8901  DTSLEPVTTS PPSMNITSDE SLATSKATME TEAIQLSENT AVTQMGTISA o    o     o o     ooo   o
8951  RQEFYSSYPG LPEPSKVTSP VVTSSTIKDI VSTTIPASSE ITRIEMESTS o o o   oo oo    o o   oo                   oo
9001  TLTPTPRETS TSQEIHSATK PSTVPYKALT SATIEDSMTQ VMSSSRGPSP oo      o       o         o      oo o o   o
9051  DQSTMSQDIS TEVITRLSTS PIKAESTEMT ITTQTGSPGA TSRGTLTLDT o           o                         o
9101  STTFMSGTHS TASQGFSHSQ MTALMSRTPG DVPWLSHPSV EEASSASFSL oo     ooo    ooo       o                 oo    oo
9151  SSPVMTSSSP VSSTLPDSIH SSSLPVTSLL TSGLVKTTEL LGTSSEPETS o  x oooo     oo  o                       o       o
9201  SPPNLSSTSA EILATTEVTT DTEKLEMTNV VTSGYTHESP SSVLADSVTT o o         o o                          o o
9251  KATSSMGITY PTGDTNVLTS TPAFSDTSRI QTKSKLSLTP GLMETSISEE oo  o oo    oo  o oo      o  oo    oo       oo  o
9301  TSSATEKSTV LSSVPTGATT EVSRTEAISS SRTSIPGPAQ STMSSDTSME o          o   o           o   o o    o
9351  TITRISTPLT RKESTDMAIT PKTGPSGATS QGTFTLDSSS TASWPGTHSA o          o  o                 o  o ooo oo o
9401  TTQRFPQSVV TTPMSRGPED VSWPSPLSVE KNSPPSSLVS SSSVTSPSPL oo o oo o o                          oo      x
9451  YSTPSGSSHS SPVPVTSLFT SIMMKATDML DASLEPETTS APNMNITSDE o                  o   o   ooo    o
9501  SLAASKATTE TEAIHVFENT AASHVETTSA TEELYSSSPG FSEPTKVISP o o       oo   o           o             o  oo
9551  VVTSSSIRDN MVSTTMPGSS GITRIEIESM SSLTPGLRET RTSQDITSST o          o        o   o oo     o
9601  ETSTVLYKMP SGATPEVSRT EVMPSSRTSI PGPAQSTMSL DISDEVVTRL o                    o                   o
9651  STSPIMTESA EITITTQTGY SLATSQVTLP LGTSMTFLSG THSTMSQGLS o   o oo     o o     o
9701  HSEMTNLMSR GPESLSWTSP RFVETTRSSS SLTSLPLTTS LSPVSSTLLD o o     o            oo    ooo x oo oo     oo
9751  SSPSSPLPVT SLILPGLVKT TEVLDTSSEP KTSSSPNLSS TSVEIPATSE o          o                           o  oo
9801  IMTDTEKIHP SSNTAVAKVR TSSSVHESHS SVLADSETTI TIPSMGITSA o                o   o      ooo  o o
9851  VDDTTVFTSN PAFSETRRIP TEPTFSLTPG FRETSTSEET TSITETSAVL oo oo                  o o       o
9901  YGVPTSATTE VSMTEIMSSN RIHIPDSDQS TMSPDIITEV ITRLSSSSMM o oo     o   oo    o  o
9951  SESTQMTITT QKSSPGATAQ STLTWPQQQP PWQGPTQLFL LDFYTSEMTT
```

TABLE 26-continued

Serine/Threonine O-Glycosylation Pattern for the
CA125 Amino Terminal Extension
(SEQ ID NO: 310)

```
                      o  o    ooo o ooo          oo
10001  LMSRSPENPS WKSSLFVEKT SSSSSLLSLP VTTSPSVSST LPQSIPSSSF o              oo     o  o x                   o
10051  SVTSLLTPGM VKTTDTSTEP GTSLSPNLSG TSVEILAASE VTTDTEKIHP o                   o    o   o  o    o ooo
10101  SSSMAVTNVG TTSSGHELYS SVSIHSEPSK ATYPVGTPSS MAETSISTSM x   o oo o o o o  o      o
10151  PANFETTGFE AEPFSHLTSG FRKTNMSLDT SSVTPTNTPS SPGSTHLLQS o o   o o    o   o              o o   o
10201  SKTDFTSSAK TSSPDWPPAS QYTEIPVDII TPFNASPSIT ESTGITSFPE o  o  o         o o o o   o  o       oo
10251  SRFTMSVTES THHLSTDLLP SAETISTGTV MPSLSEAMTS FATTGVPRAI o        o      o o    ooo     oooo o oo ooo
10301  SGSGSPFSRT ESGPGDATLS TIAESLPSST PVPFSSSTFT TTDSSTIPAL oooo       o  o                    o       ooo
10351  HEITSSSATP YRVDTSLGTE SSTTEGRLVM VSTLDTSSQP GRTSSTPILD o            o
10401  TRMTESVELG TVTSAYQVPS LSTRLTRTDG I
```

TABLE 27

Genomic CA125 Amino Terminal Sequence
(SEQ ID NO: 311)

```
   1  GGTGCGCACC ACTATGTCTG CTAATTTTTT GTATTTTTTT GTAGAGACAT
  51  GGTTTCACCA TGTTGGCCAG GCTGGTCTCG AATTCCTGAC TTCAAGTAAT
 101  CCACCCACCT CAGCCTCCCA AAGTGCTGGG ATTACAAGCA TGAGCCACCA
 151  TGCATGGCCT AAAGCTTCTT TTAAAGCCAC CAAGTCCCTT CCCATGTTAG
 201  CCCACTAATC CATGGGTTAG TCATGAATGG ATTAATCTAT TCATACGGAC
 251  AGAGCCCTCA TCACCCAATC ACCTCTTAAA GGCCCCACCT CTCAATACTG
 301  CCACACTGGG GATTAAGTTT CAACAGAGTT TTGGAGGGGA CATTCAAATC
 351  ATAGTAATGC CCAAAGTGAA AAATCTTCCC TGCACTTTTC CCTCAACAAA
 401  AACAGCCAGA GATAGTGAGC TGCCAGGAAA TTCTTTTTTT TTTCCTCTTC
 451  TGTCCTAAAT CAGCATCGCT AGACCTTTAC ATGATTCAAC CTCATCTTCT
 501  TCACCCTCTG GGTCATGAAA TTTTATTTAT TTATTTATTA TTTTCTTGGG
 551  ACAGACTCTG GCTCTGTCGC CCAGGCTGAA GTGCAGTGGT GTGATCTTGG
 601  CTCACTGCAA CCTCCGCCTC CCGGGTTCAA GCGATTCTCC TGCCTCAGCC
 651  TCCTGAGTAG CTGGGATTAC AGGTGGGCGC CACCACACCC AGCTAATTTT
 701  TTGTATTTTT AGTAGAGATG GGGTTTCACC ATATTAGCCA GGATGGTCTC
 751  CATCTCTTGA CCTCGTGATC TGCCCACCTC AGCCTCCCAA AATGCTGGGA
 801  TTACAGGCAT GAGACACCAC GCCCAGCAGG CCAGGGTCAT GAGATTTTAA
 851  TCAAGAGCAA CTTCCACTGA TTCCTGAGAG TGCATCTGTG GGCCCCTGCT
 901  CTGATCTGAA CAGAAGTGCC GTGTCTTCTC TGACCTCCAC TTCTCAATTC
 951  AAGAGCCTTA GTATCTGCCA GTATCACACA CTGAGCATTA GCTCCATCTC
1001  ATGGGGGTGT AGGTAGGGGC TCTATCTGCA TCTTTCTTTC TTTTTTTCTT
```

TABLE 27-continued

Genomic CA125 Amino Terminal Sequence
(SEQ ID NO: 311)

```
1051  TCTTTCCCTT CCTCCCTTCC TCACTCCCTC GGTCCTCTCT TTCTTTCCTT
1101  TTCTTTCTTC CTTCCTCCCT TCCTCCCTCC CTCCCTCTCT CTTTCTCTCT
1151  TTCTTTCTTT CCTTCTTTCT TTCTTTCTCT CTTCCTTCCC TCCCTCCCTC
1201  CTTCCTTCCT TTCTCTTTCT TTCTCTTTCT TTCTTTTTTT CCTTCCTTCC
1251  TTCCTTCTTT CTCTTTCTCT CCCTCCCTTC CTTCCTTCCT TCCTTCCTTC
1301  CTTCCTTTCT TTCTTTCTTT CTTTCTTTCT TTCTTTCTTT CTTTCTTTCT
1351  TTCTTTCTTC CTTCCTTCCT TCCTTCCTTC CTTCCTTCCT TCCTTCCTTT
1401  CTTTTCTTTC TTTCTCTTTC TTTTTGAGAC AGAGCTCTTA TTACCCATGC
1451  TGGAGTGCAG TGGTGTGACC TTGGCTTACT GCAACATCTG CCTCCTAGGG
1501  TCAAGTGATT CTCCTGCCTC AGCCTCCTAA GTAGCTGGGA TTACAGACAC
1551  ATGCCACCAC ACCCAATATT TATTTTTATT AAAATTTTTT TTAAAATTAT
1601  TTTTAAAAAA TTAAAAATAA TTTTGTATTT TTAGTAGAGA CGGGGTTTCT
1651  CCATGTTGGT CAGGCTGATC TCAAACTCCC AACCTCAGGT GATCCTCCCA
1701  CCTCACCTCC CAAAGTGCTG GGATTACAGG CATGAGCCAC CGTGCCCAGC
1751  CTGGTTCCTG GTTTCTAAGA CATCACACAC ACACACACAC ACACACACAC
1801  ACACTCACAC ACTCAGAGAG AGAGAGAGAG AGAGGATCAT TAAGACATGA
1851  TACACTAAGA AATTCTATTC TGCAGACACT GAGAATCCGT TAAAAAGTTT
1901  GAAGGGAAGA ATTGAGATCA TCAGGTGTTT ATTTGAGGAA ATTGTCTGTG
1951  GTTGAACTAT CCTTTCCTTT CTCTCCCTGA GATTTGGTCT TCTCAATTAG
2001  AAGCGTTGCA CAATTCCCCC AACCTCCATA CATACGGCAG CTCTTCTAGA
2051  CACAGGTTTT CCCAGGTCAA ATGCGGGGAC CCCAGCCATA TCTCCCACCC
2101  TGAGAAATTT TGGAGTTTCA GGGAGCTCAG AAGCTCTGCA GAGGCCACCC
2151  TCTCTGAGGG GATTCTTCTT AGACCTCCAT CCAGAGGCAA ATGTTGACCT
```

Exon 1

```
2201  GTCCATGCTG AAACCCTCAG GCCTTCCTGG GTCATCTTCT CCCACCCGCT
2251  CCTTGATGAC AGGGAGCAGG AGCACTAAAG CCACACCAGA AATGGATTCA
2301  GGACTGACAG GAGCCACCTT GTCACCTAAG ACATCTACAG GTGCAATCGT
2351  GGTGACAGAA CATACTCTGC CCTTTACTTC CCCAGATAAG ACCTTGGCCA
2401  GTCCTACATC TTCGGTTGTG GGAAGAACCA CCCAGTCTTT GGGGGTGATG
2451  TCCTCTGCTC TCCCTGAGTC AACCTCTAGA GGAATGACAC ACTCCGAGCA
2501  AAGAACCAGC CCATCGCTGA GTCCCCAGGT CAATGGAACT CCCTCTAGGA
2551  ACTACCCTGC TACAAGCATG GTTTCAGGAT TGAGTTCCCC AAGGACCAGG
2601  ACCAGTTCCA CAGAAGGAAA TTTTACCAAA GAAGCATCTA CATACACACT
2651  CACTGTAGAG ACCACAAGTG GCCCAGTCAC TGAGAAGTAC ACAGTCCCCA
2701  CTGAGACCTC AACAACTGAA GGTGACAGCA CAGAGACCCC CTGGGACACA
2751  AGATATATTC CTGTAAAAAT CACATCTCCA ATGAAAACAT TTGCAGATTC
2801  AACTGCATCC AAGGAAAATG CCCCAGTGTC TATGACTCCA GCTGAGACCA
2851  CAGTTACTGA CTCACATACT CCAGGAAGGA CAAACCCATC ATTTGGGACA
```

TABLE 27-continued

Genomic CA125 Amino Terminal Sequence
(SEQ ID NO: 311)

```
2901 CTTTATTCTT CCTTCCTTGA CCTATCACCT AAAGGGACCC CAAATTCCAG
2951 AGGTGAAACA AGCCTGGAAC TGATTCTATC AACCACTGGA TATCCCTTCT
3001 CCTCTCCTGA ACCTGGCTCT GCAGGACACA GCAGAATAAG TACCAGTGCG
3051 CCTTTGTCAT CATCTGCTTC AGTTCTGAT AATAAAATAT CAGAGACCAG
3101 CATATTCTCA GGCCAGAGTC TCACCTCCCC TCTGTCTCCT GGGGTGCCCG
3151 AGGCCAGAGC CAGCACAATG CCCAACTCAG CTATCCCTTT TTCCATGACA
3201 CTAAGCAATG CAGAAACAAG TGCCGAAAGG GTCAGAAGCA CAATTTCCTC
3251 TCTGGGACT CCATCAATAT CCACAAAGCA GACAGCAGAG ACTATCCTTA
3301 CCTTCCATGC CTTCGCTGAG ACCATGGATA TACCCAGCAC CCACATAGCC
3351 AAGACTTTGG CTTCAGAATG GTTGGGAAGT CCAGGTACCC TTGGTGGCAC
3401 CAGCACTTCA GCGCTGACAA CCACATCTCC ATCTACCACT TTAGTCTCAG
3451 AGGAGACCAA CACCCATCAC TCCACGAGTG GAAAGGAAAC AGAAGGAACT
3501 TTGAATACAT CTATGACTCC ACTTGAGACC TCTGCTCCTG GAGAAGAGTC
3551 CGAAATGACT GCCACCTTGG TCCCCACTCT AGGTTTTACA ACTCTTGACA
3601 GCAAGATCAG AAGTCCATCT CAGGTCTCTT CATCCCACCC AACAAGAGAG
3651 CTCAGAACCA CAGGCAGCAC CTCTGGGAGG CAGAGTTCCA GCACAGCTGC
3701 CCACGGGAGC TCTGACATCC TGAGGGCAAC CACTTCCAGC ACCTCAAAAG
3751 CATCATCATG GACCAGTGAA AGCACAGCTC AGCAATTTAG TGAACCCCAG
3801 CACACACAGT GGGTGGAGAC AAGTCCTAGC ATGAAAACAG AGAGACCCCC
3851 AGCATCAACC AGTGTGGCAG CCCCTATCAC CACTTCTGTT CCCTCAGTGG
3901 TCTCTGGCTT CACCACCCTG AAGACCAGCT CCACAAAAGG GATTTGGCTT
3951 GAAGAAACAT CTGCAGACAC ACTCATCGGA GAATCCACAG CTGGCCCAAC
4001 CACCCATCAG TTTGCTGTTC CCACTGGGAT TTCAATGACA GGAGGCAGCA
4051 GCACCAGGGG AAGCCAGGGC ACAACCCACC TACTCACCAG AGCCACAGCA
4101 TCATCTGAGA CATCCGCAGA TTTGACTCTG GCCACGAACG GTGTCCCAGT
4151 CTCCGTGTCT CCAGCAGTGA GCAAGACGGC TGCTGGCTCA AGTCCTCCAG
4201 GAGGGACAAA GCCATCATAT ACAATGGTTT CTTCTGTCAT CCCTGAGACA
4251 TCATCTCTAC AGTCCTCAGC TTTCAGGGAA GGAACCAGCC TGGGACTGAC
4301 TCCATTAAAC ACTAGACATC CCTTCTCTTC CCCTGAACCA GACTCTGCAG
4351 GACACACCAA GATAAGCACC AGCATTCCTC TGTTGTCATC TGCTTCAGTT
4401 CTTGAGGATA AAGTGTCAGC GACCAGCACA TTCTCACACC ACAAAGCCAC
4451 CTCATCTATT ACCACAGGGA CTCCTGAAAT CTCAACAAAG ACAAAGCCCA
4501 GCTCAGCCGT TCTTTCCTCC ATGACCCTAA GCAATGCAGC AACAAGTCCT
4551 GAAAGAGTCA GAAATGCAAC TTCCCCTCTG ACTCATCCAT CTCCATCAGG
4601 GGAAGAGACA GCAGGGAGTG TCCTCACTCT CAGCACCTCT GCTGAGACTA
4651 CAGACTCACC TAACATCCAC CCAACTGGGA CACTGACTTC AGAATCGTCA
4701 GAGAGTCCTA GCACTCTCAG CCTCCCAAGT GTCTCTGGAG TCAAAACCAC
4751 ATTTTCTTCA TCTACTCCTT CCACTCATCT ATTTACTAGT GGAGAAGAAA
4801 CAGAGGAAAC TTCGAATCCA TCTGTGTCTC AACCTGAGAC TTCTGTTTCC
```

TABLE 27-continued

Genomic CA125 Amino Terminal Sequence
(SEQ ID NO: 311)

| | |
|---|---|
| 4851 | AGAGTAAGGA CCACCTTGGC CAGCACCTCT GTCCCTACCC CAGTATTCCC |
| 4901 | CACCATGGAC ACCTGGCCTA CACGTTCAGC TCAGTTCTCT TCATCCCACC |
| 4951 | TAGTGAGTGA GCTCAGAGCT ACGAGCAGTA CCTCAGTTAC AAACTCAACT |
| 5001 | GGTTCAGCTC TTCCTAAAAT ATCTCACCTC ACTGGGACGG CAACAATGTC |
| 5051 | ACAGACCAAT AGAGACACGT TAATGACTC TGCTGCACCC CAAAGCACAA |
| 5101 | CTTGGCCAGA GACTAGTCCC AGATTCAAGA CAGGGTTACC TTCAGCAACA |
| 5151 | ACCACTGTTT CAACCTCTGC CACTTCTCTC TCTGCTACTG TAATGGTCTC |
| 5201 | TAAATTCACT TCTCCAGCAA CTAGTTCCAT GGAAGCAACT TCTATCAGGG |
| 5251 | AACCATCAAC AACCATCCTC ACAACAGAGA CCACGAATGG CCCAGGCTCT |
| 5301 | ATGGCTGTGG CTTCTACCAA CATCCCAATT GGAAAGGGCA ACATTACTGA |
| 5351 | AGGAAGATTG GACACAAGCC ATCTGCCCAT GGAACCACA GCTTCCTCTG |
| 5401 | AGACATCTAT GGATTTTACC ATGGCCAAAG AAAGTGTCTC AATGTCAGTA |
| 5451 | TCTCCATCTC AGTCCATGGA TGCTGCTGGC TCAAGCACTC CAGGAAGGAC |
| 5501 | AAGCCAATTC GTTGACACAT TTTCTGATGA TGTCTATCAT TTAACATCCA |
| 5551 | GAGAAATTAC AATACCTAGA GATGGAACAA GCTCAGCTCT GACTCCACAA |
| 5601 | ATGACTGCAA CTCACCCTCC ATCTCCTGAT CCTGGCTCTG CTAGAAGCAC |
| 5651 | CTGGCTTGGC ATCTTGTCCT CATCTCCTTC TTCTCCTACT CCCAAAGTCA |
| 5701 | CAATGAGCTC CACATTTTCA ACTCAGAGAG TCACCACAAG CATGATAATG |
| 5751 | GACACAGTTG AAACTAGTCG GTGGAACATG CCCAACTTAC CTTCCACGAC |
| 5801 | TTCCTTGACA CCAAGTAATA TTCCAACAAG TGGTGCCATA GGAAAAAGCA |
| 5851 | CCCTGGTTCC CTTGGACACT CCATCTCCAG CCACATCATT GGAGGCATCA |
| 5901 | GAAGGGGAC TTCCAACCCT CAGCACCTAC CCTGAATCAA CAAACACACC |
| 5951 | CAGCATCCAC CTCGGAGCAC ACGCTAGTTC AGAAAGTCCA AGCACCATCA |
| 6001 | AACTTACCAT GGCTTCAGTA GTAAAACCTG GCTCTTACAC ACCTCTCACC |
| 6051 | TTCCCCTCAA TAGAGACCCA CATTCATGTA TCAACAGCCA GAATGGCTTA |
| 6101 | CTCTTCTGGG TCTTCACCTG AGATGACAGC TCCTGGAGAG ACTAACACTG |
| 6151 | GTAGTACCTG GGACCCCACC ACCTACATCA CCACTACGGA TCCTAAGGAT |
| 6201 | ACAAGTTCAG CTCAGGTCTC TACACCCCAC TCAGTGAGGA CACTCAGAAC |
| 6251 | CACAGAAAAC CATCCAAAGA CAGAGTCCGC CACCCCAGCT GCTTACTCTG |
| 6301 | GAAGTCCTAA AATCTCAAGT TCACCCAATC TCACCAGTCC GGCCACAAAA |
| 6351 | GCATGGACCA TCACAGACAC AACTGAACAC TCCACTCAAT TACATTACAC |
| 6401 | AAAATTGGCA GAAAAATCAT CTGGATTTGA GACACAGTCA GCTCCAGGAC |
| 6451 | CTGTCTCTGT AGTAATCCCT ACCTCCCCTA CCATTGGAAG CAGCACATTG |
| 6501 | GAACTAACTT CTGATGTCCC AGGGGAACCC CTGGTCCTTG CTCCCAGTGA |
| 6551 | GCAGACCACA ATCACTCTCC CCATGGCAAC ATGGCTGAGT ACCAGTTTGA |
| 6601 | CAGAGGAAAT GGCTTCAACA GACCTTGATA TTTCAAGTCC AAGTTCACCC |
| 6651 | ATGAGTACAT TTGCTATTTT TCCACCTATG TCCACACCTT CTCATGAACT |
| 6701 | TTCAAAGTCA GAGGCAGATA CCAGTGCCAT TAGAAATACA GATTCAACAA |

TABLE 27-continued

Genomic CA125 Amino Terminal Sequence
(SEQ ID NO: 311)

```
6751  CGTTGGATCA GCACCTAGGA ATCAGGAGTT TGGGCAGAAC TGGGGACTTA
6801  ACAACTGTTC CTATCACCCC ACTGACAACC ACGTGGACCA GTGTGATTGA
6851  ACACTCAACA CAAGCACAGG ACACCCTTTC TGCAACGATG AGTCCTACTC
6901  ACGTGACACA GTCACTCAAA GATCAAACAT CTATACCAGC CTCAGCATCC
6951  CCTTCCCATC TTACTGAAGT CTACCCTGAG CTCGGGACAC AAGGGAGAAG
7001  CTCCTCTGAG GCAACCACTT TTTGGAAACC ATCTACAGAC ACACTGTCCA
7051  GAGAGATTGA GACTGGCCCA ACAAACATTC AATCCACTCC ACCCATGGAC
7101  AACACAACAA CAGGGAGCAG TAGTAGTGGA GTCACCCTGG GCATAGCCCA
7151  CCTTCCCATA GGAACATCCT CCCCAGCTGA GACATCCACA AACATGGCAC
7201  TGGAAAGAAG AAGTTCTACA GCCACTGTCT CTATGGCTGG GACAATGGGA
7251  CTCCTTGTTA CTAGTGCTCC AGGAAGAAGC ATCAGCCAGT CATTAGGAAG
7301  AGTTTCCTCT GTCCTTTCTG AGTCAACTAC TGAAGGAGTC ACAGATTCTA
7351  GTAAGGGAAG CAGCCCAAGG CTGAACACAC AGGGAAATAC AGCTCTCTCC
7401  TCCTCTCTTG AACCCAGCTA TGCTGAAGGA AGCCAGATGA GCACAAGCAT
7451  CCCTCTAACC TCATCTCCTA CAACTCCTGA TGTGGAATTC ATAGGGGGCA
7501  GCACATTTTG GACCAAGGAG GTCACCACAG TTATGACCTC AGACATCTCC
7551  AAGTCTTCAG CAAGGACAGA GTCCAGCTCA GCTACCCTTA TGTCCACAGC
7601  TTTGGGAAGC ACTGAAAATA CAGGAAAAGA AAAACTCAGA ACTGCCTCTA
7651  TGGATCTTCC ATCTCCAACT CCATCAATGG AGGTGACACC ATGGATTTCT
7701  CTCACTCTCA GTAATGCCCC CAATACCACA GATTCACTTG ACCTCAGCCA
7751  TGGGGTGCAC ACCAGCTCTG CAGGGACTTT GGCCACTGAC AGGTCATTGA
7801  ATACTGGTGT CACTAGAGCC TCCAGATTGG AAAACGGCTC TGATACCTCT
7851  TCTAAGTCCC TGTCTATGGG AAACAGCACT CACACTTCCA TGACTTACAC
7901  AGAGAAGAGT GAAGTGTCTT CTTCAATCCA TCCCCGACCT GAGACCTCAG
7951  CTCCTGGAGC AGAGACCACT TTGACTTCCA CTCCTGGAAA CAGGGCCATA
8001  AGCTTAACAT TGCCTTTTTC ATCCATTCCA GTGGAAGAAG TCATTTCTAC
8051  AGGCATAACC TCAGGACCAG ACATCAACTC AGCACCCATG ACACATTCTC
8101  CCATCACCCC ACCAACAATT GTATGGACCA GTACAGGCAC AATTGAACAG
8151  TCCACTCAAC CACTACATGC AGTTTCTTCA GAAAAAGTTT CTGTGCAGAC
8201  ACAGTCAACT CCATATGTCA ACTCTGTGGC AGTGTCTGCT TCCCCTACCC
8251  ATGAGAATTC AGTCTCTTCT GGAAGCAGCA CATCCTCTCC ATATTCCTCA
8301  GCCTCACTTG AATCCTTGGA TTCCACAATC AGTAGGAGGA ATGCAATCAC
8351  TTCCTGGCTA TGGGACCTCA CTACATCTCT CCCCACTACA ACTTGGCCAA
8401  GTACTAGTTT ATCTGAGGCA CTGTCCTCAG GCCATTCTGG GGTTTCAAAC
8451  CCAAGTTCAA CTACGACTGA ATTTCCACTC TTTTCAGCTG CATCCACATC
8501  TGCTGCTAAG CAAAGAAATC CAGAAACAGA GACCCATGGT CCCCAGAATA
8551  CAGCCGCGAG TACTTTGAAC ACTGATGCAT CCTCGGTCAC AGGTCTTTCT
8601  GAGACTCCTG TGGGGGCAAG TATCAGCTCT GAAGTCCCTC TTCCAATGGC
8651  CATAACTTCT AGATCAGATG TTTCTGGCCT TACATCTGAG AGTACTGCTA
```

TABLE 27-continued

Genomic CA125 Amino Terminal Sequence
(SEQ ID NO: 311)

| | |
|---|---|
| 8701 | ACCCGAGTTT AGGCACAGCC TCTTCAGCAG GGACCAAATT AACTAGGACA |
| 8751 | ATATCCCTGC CCACTTCAGA GTCTTTGGTT TCCTTTAGAA TGAACAAGGA |
| 8801 | TCCATGGACA GTGTCAATCC CTTTGGGGTC CCATCCAACT ACTAATACAG |
| 8851 | AAACAAGCAT CCCAGTAAAC AGCGCAGGTC CACCTGGCTT GTCCACAGTA |
| 8901 | GCATCAGATG TAATTGACAC ACCTTCAGAT GGGGCTGAGA GTATTCCCAC |
| 8951 | TGTCTCCTTT TCCCCCTCCC CTGATACTGA AGTGACAACT ATCTCACATT |
| 9001 | TCCCAGAAAA GACAACTCAT TCATTTAGAA CCATTTCATC TCTCACTCAT |
| 9051 | GAGTTGACTT CAAGAGTGAC ACCTATTCCT GGGGATTGGA TGAGTTCAGC |
| 9101 | TATGTCTACA AGCCCACAG GAGCCAGTCC CTCCATTACA CTGGGAGAGA |
| 9151 | GAAGGACAAT CACCTCTGCT GCTCCAACCA CTTCCCCCAT AGTTCTCACT |
| 9201 | GCTAGTTTCA CAGAGACCAG CACAGTTTCA CTGGATAATG AAACTACAGT |
| 9251 | AAAAACCTCA GATATCCTTG ACGCACGGAA AACAAATGAG CTCCCCTCAG |
| 9301 | ATAGCAGTTC TTCTTCTGAT CTGATCAACA CCTCCATAGC TTCTTCAACT |
| 9351 | ATGGATGTCA CTAAAACAGC CTCCATCAGT CCCACTAGCA TCTCAGGAAT |
| 9401 | GACAGCAAGT TCCTCCCCAT CTCTCTTCTC TTCAGATAGA CCCCAGGTTC |
| 9451 | CCACATCTAC AACAGAGACA AATACAGCCA CCTCTCCATC TGTTTCCAGT |
| 9501 | AACACCTATT CTCTTGATGG GGGCTCCAAT GTGGGTGGCA CTCCATCCAC |
| 9551 | TTTACCACCC TTTACAATCA CCCACCCTGT CGAGACAAGC TCGGCCCTAT |
| 9601 | TAGCCTGGTC TAGACCAGTA AGAACTTTCA GCACCATGGT CAGCACTGAC |
| 9651 | ACTGCCTCCG GAGAAAATCC TACCTCTAGC AATTCTGTGG TGACTTCTGT |
| 9701 | TCCAGCACCA GGTACATGGA CCAGTGTAGG CAGTACTACT GACTTACCTG |
| 9751 | CCATGGGCTT TCTCAAGACA AGTCCTGCAG GAGAGGCACA CTCACTTCTA |
| 9801 | GCATCAACTA TTGAACCAGC CACTGCCTTC ACTCCCCATC TCTCAGCAGC |
| 9851 | AGTGGTCACT GGATCCAGTG CTACATCAGA AGCCAGTCTT CTCACTACGA |
| 9901 | GTGAAAGCAA AGCCATTCAT TCTTCACCAC AGACCCCAAC TACACCCACC |
| 9951 | TCTGGAGCAA ACTGGGAAAC TTCAGCTACT CCTGAGAGCC TTTTGGTAGT |
| 10001 | CACTGAGACT TCAGACACAA CACTTACCTC AAAGATTTTG GTCACAGATA |
| 10051 | CCATCTTGTT TTCAACTGTG TCCACGCCAC CTTCTAAATT TCCAAGTACG |
| 10101 | GGGACTCTGT CTGGAGCTTC CTTCCCTACT TTACTCCCGG ACACTCCAGC |
| 10151 | CATCCCTCTC ACTGCCACTG AGCCAACAAG TTCATTAGCT ACATCCTTTG |
| 10201 | ATTCCACCCC ACTGGTGACT ATAGCTTCGG ATAGTCTTGG CACAGTCCCA |
| 10251 | GAGACTACCC TGACCATGTC AGAGACCTCA AATGGTGATG CACTGGTTCT |
| 10301 | TAAGACAGTA AGTAACCCAG ATAGGAGCAT CCCTGGAATC ACTATCCAAG |
| 10351 | GAGTAACAGA AAGTCCACTC CATCCTTCTT CCACTTCCCC CTCTAAGATT |
| 10401 | GTTGCTCCAC GGAATACAAC CTATGAAGGT TCGATCACAG TGGCACTTTC |
| 10451 | TACTTTGCCT GCGGGAACTA CTGGTTCCCT TGTATTCAGT CAGAGTTCTG |
| 10501 | AAAACTCAGA GACAACGGCT TTGGTAGACT CATCAGCTGG GCTTGAGAGG |
| 10551 | GCATCTGTGA TGCCACTAAC CACAGGAAGC CAGGGTATGG CTAGCTCTGG |

TABLE 27-continued

Genomic CA125 Amino Terminal Sequence
(SEQ ID NO: 311)

| | |
|---|---|
| 10601 | AGGAATCAGA AGTGGGTCCA CTCACTCAAC TGGAACCAAA ACATTTTCTT |
| 10651 | CTCTCCCTCT GACCATGAAC CCAGGTGAGG TTACAGCCAT GTCTGAAATC |
| 10701 | ACCACGAACA GACTGACAGC TACTCAATCA ACAGCACCCA AAGGGATACC |
| 10751 | TGTGAAGCCC ACCAGTGCTG AGTCAGGCCT CCTAACACCT GTCTCTGCCT |
| 10801 | CCTCAAGCCC ATCAAAGGCC TTTGCCTCAC TGACTACAGC TCCCCCAACT |
| 10851 | TGGGGGATCC CACAGTCTAC CTTGACATTT GAGTTTTCTG AGGTCCCAAG |
| 10901 | TTTGGATACT AAGTCCGCTT CTTTACCAAC TCCTGGACAG TCCCTGAACA |
| 10951 | CCATTCCAGA CTCAGATGCA AGCACAGCAT CTTCCTCACT GTCCAAGTCT |
| 11001 | CCAGAAAAAA ACCCAAGGGC AAGGATGATG ACTTCCACAA AGGCCATAAG |
| 11051 | TGCAAGCTCA TTTCAATCAA CAGGTTTTAC TGAAACCCCT GAGGGATCTG |
| 11101 | CCTCCCCTTC TATGGCAGGG CATGAACCCA GAGTCCCCAC TTCAGGAACA |
| 11151 | GGGGACCCTA GATATGCCTC AGAGAGCATG TCTTATCCAG ACCCAAGCAA |
| 11201 | GGCATCATCA GCTATGACAT CGACCTCTCT TGCATCAAAA CTCACAACTC |
| 11251 | TCTTCAGCAC AGGTCAAGCA GCAAGGTCTG GTTCTAGTTC CTCTCCCATA |
| 11301 | AGCCTATCCA CTGAGAAAGA AACAAGCTTC CTTTCCCCCA CTGCATCCAC |
| 11351 | CTCCAGAAAG ACTTCACTAT TTCTTGGGCC TTCCATGGCA AGGCAGCCCA |
| 11401 | ACATATTGGT GCATCTTCAG ACTTCAGCTC TGACACTTTC TCCAACATCC |
| 11451 | ACTCTAAATA TGTCCCAGGA GGAGCCTCCT GAGTTAACCT CAAGCCAGAC |
| 11501 | CATTGCAGAA GAAGAGGGAA CAACAGCTGA ACACAGACG TTAACCTTCA |
| 11551 | CACCATCTGA GACCCCAACA TCCTTGTTAC CTGTCTCTTC TCCCACAGAA |
| 11601 | CCCACAGCCA GAAGAAAGAG TTCTCCAGAA ACATGGGCAA GCTCTATTTC |
| 11651 | AGTTCCTGCC AAGACCTCCT TGGTTGAAAG TAAGAATGCC CTGCTCCTTC |
| 11701 | CCCAAGTGTG CTGGGGATGA ATCTGGAAAT AAACTACATC TTTTTTATTT |
| 11751 | TTTAAACTTT TATATTTGAA AATATAAATA TTTTAGGTTC AGGGAACATG |
| 11801 | TGCAGGTTTG TTATATAGGT AAATTGCATG TCATGGGGGC TTGGGGTACA |
| 11851 | GATTACATCA TCAGCCAGGT AATAAGCCTA GTACCTGATC AGTAGATTTT |
| 11901 | TTTTAATCCT CTCCCTCCTC CCAGCCTCCA CCCTCAATTC ACATGTCTCC |
| 11951 | ATGTGTACTC AAGGTTTAAT TCCCACTTAT GAGTGAGAAC ATGCGGTATT |
| 12001 | TGTAAACTAC ATCTTTATTT TTGCTAACCT CGAACTGAAA TTTAGCATTT |
| 12051 | GTTTTATTGA TGAATAGAGG TAACAAAACA AACCACATTA ATCCTAGCAG |
| 12101 | TGCCTGTGCC TTTGCCAACA ACAGAAATTC CGGACACTTT CATATCCTAT |
| 12151 | GACAATTGTT GCAAGCACTT TTAAAAATCA TGTACGACTT TATTCATAAT |
| 12201 | TATAGTGGTT ATTAGGCTTT TCAATAGATC TTATTTAATG AGTTAGTAAA |
| 12251 | ATAAGTGCCT GTATTATTGT ATTACATTTG TTTATTAAGA TCTTGATAAC |
| 12301 | AACATTTCAA TATAATCATT TCCTTTGTTT TTTAAATTTT AGATTCAGGG |
| 12351 | GTATATGTGC AGGTTTGTTA CGTGGATATA CTGCATAATG ATGAGGTTTG |
| 12401 | GCTTCTAGTG AACCCATCAG CCAAATAGTG AATGTTGTGC CAATAAGTA |
| 12451 | GTTTTTCAAT CCTCACTTCA CTCCCAGCCT CCTCTATTTT GGAGTCCCAG |
| 12501 | TGTCTATTAT TTCTATCTTT ATGTCCACAT GTACCCATTG GTTAGCTCCC |

TABLE 27-continued

Genomic CA125 Amino Terminal Sequence
(SEQ ID NO: 311)

| | | | | | |
|---|---|---|---|---|---|
| 12551 | ACTTATAAGT | GAGAATGTGC | AGTATTTAAT | TTTCTGTTTT | TGAGTTATTT |
| 12601 | TGCTTAGGTT | GATGGCCTTC | AGCTCCAGCC | ACGTTGCTTT | AAAGAACATG |
| 12651 | ATTTCATTCT | TTTTTATGGC | TGCATAGTAC | TCCGAGGTGT | ATGTGTACCA |
| 12701 | GATTTTCTTT | ATCCACAATG | ATTTCCTTTG | TAATCTAATA | TTTTATATTG |
| 12751 | TTATTTTATG | TTTTATTCTA | TATTTTTATT | TTAATTTATA | AAGGAATTCA |
| 12801 | TATGGTTCAC | AAGCCTGTCA | AAGGGACCTA | TAATAAAAAG | AGGTTAAGAA |
| 12851 | TCCATGCTCT | AAACAGAATA | TTACTCCATT | TTATTTCATT | TATTTTTAAA |
| 12901 | GAGACAGTCT | CACTCTGTCA | TCCAGGCTGG | AGTACAGTGG | AGTGATCATA |
| 12951 | GCTCATTGCA | ACCCTGAACT | CTTGGGCACA | AGCAATTCTC | CTGCTTCATC |
| 13001 | CTCCAGAGGA | GCTGGGACTA | CAGGTGCACA | TCACCATGCC | CAGCTAGTTT |
| 13051 | TAAAAATTAT | TTTGTAGAGA | TGGTGTCTCA | CTATCCTACC | CAGGCTGGTC |
| 13101 | TCAAACTCCT | GGGCTCAGGC | AATCCTCCCA | CTTTGACCTC | CCAAAGTGTT |
| 13151 | GAGATTACAG | GGGCAAGCCA | CTGTGCCTGG | CCACTTGTCA | CATTTTAATT |
| 13201 | TGTGATTACT | TATAAAATGA | ACCCCTTCCC | ATCTGAGATC | TGTCAGTCTT |
| 13251 | TCTGGTGACG | GTGCCTGGTG | TCTGCTTTCT | ACCATGTCCT | GTTAGACTAG |
| 13301 | TGTTTGATGG | GAGGTCACCT | GGGCAGCTGT | CCAGCTCACT | CACTGGGCTC |
| 13351 | TAGAGCCTCT | GAGTTGAAGC | AAAATAGAAA | GATCAGTCAA | TGTAAAGAAA |
| 13401 | GCTCAAAAAC | TGACATTCTG | AAGTAATGGA | TAGCTAAACC | TTCCTATTGC |

Exon 2

| | | | | | |
|---|---|---|---|---|---|
| 13451 | CCTTTTCTTT | CAG<u>CAACTGA</u> | <u>TGGAACGCTA</u> | <u>GTGACCACCA</u> | <u>TAAAGATGTC</u> |
| 13501 | <u>AAGCCAGGCA</u> | <u>GCACAAGGAA</u> | <u>ATTCCACGTG</u> | <u>GCCTGCCCCA</u> | <u>GCAGAGGAGA</u> |
| 13551 | <u>CGGGGACCAG</u> | <u>TCCAGCAGGT</u> | AAATATAGAC | CTTGTTTCCA | TTTCTGCTCT |
| 13601 | GCTAATGCCA | CCCAAGCCTT | TCTTTTCTTT | TCTTTTCTTT | TCTTTTCTTT |
| 13651 | TCTTTTCTTT | TCTTTTCTTT | CTCTCCCTTT | CTTTCTTTCT | TTCTTTCTTT |
| 13701 | CTTTCTTTCT | TTCTTTCTTT | CTTTCTTTCT | CTTTCTTTCT | TTCTTTCTTT |
| 13751 | CTTTCTTTCT | TTCTTTCTTT | CTTTCTTTCT | CTTTCTTTCT | TCTTTCTCTC |
| 13801 | TCTCTCTTTC | TTTCTTTCTC | TTGTTCTTTT | TAAATTTTTT | ATTTTTTTAC |
| 13851 | TTAATTTTTT | TCACCCAAGC | CTTAAGGCCA | GTTTGGACCA | GATAGTGAGA |
| 13901 | CCCCACCTCT | ATAAAAAAA | TTTTTAAAAA | AAAAATAAGT | TGGGCATCGT |
| 13951 | GCAGGCCTGT | AGTCCCTGCT | ACTCGAGAGG | CCAAGGTGGG | AGGACAGCTT |
| 14001 | GCTGCTGACT | AAAAGTGCTG | CTTATTGATT | CTGGGAAGAA | AAAATATACA |
| 14051 | AGGCTTCAGT | TTCATTATTT | TATAAGTAAA | TGCTAGCAAC | TTTTCCTTTC |
| 14101 | TTTCTCTCTT | TCTCTCTTCC | TCTCTTTCTC | TCCTCTCCTT | CTCTTCTCTC |
| 14151 | TCTCTCTCTC | TCTCTCTCTC | TTTTCTCTCT | CTCTCCTTCT | CTTCTCTTCT |
| 14201 | TTCTCTCTCT | CTCTCTTTCA | TTTATTTTTG | AGACATGGTC | TCATTCTGTC |
| 14251 | ACCCAGGCTG | GAGTACAGTG | GTGTATATTT | ACTGCAGTAC | TCACTGTACT |
| 14301 | CACTGCAGCC | TCAAATTCCT | GGGCTCAAGC | TATCCTCTCA | CCTCAGCCTC |
| 14351 | CTGAGTAGCT | GGGCAGCAGT | CCAGCTCACT | CACTGGGCTC | TAGAGCCTCT |

TABLE 27-continued

Genomic CA125 Amino Terminal Sequence
(SEQ ID NO: 311)

```
14401  GTGCTATGCC CAGCTTATTG TTGTTGTTTT TTTAAATTTT TTTTTTTGTA
14451  CAGATGGGGT CTCACTATGT GGCCCAAGGT GGTCTTAAAC TCCTGGCTCC
14501  AAGAGATCCT CCCACCTCAG CCTCCCAAAG TGCAGGGATT ACAGGTGTGA
14551  GCCACTGTGC CCAGCCTAGA CAGCATTTTT TTTTTTTGAA ACAGGGTCTC
14601  CCTCTGTTGC CCAGGCTGGA GTGCAATGGC GTGTTCATGG TTCACTGCAG
14651  CCTCAGCCTC CTCAGTCTCA AGCAATCCTC CAACTTCAGC CTCCCCCAAC
14701  AGCTAGAACT GCAGGTGATC ATCACCAATT AGCCTGGTTA ATTGTGTGTG
14751  TATTTCTTAA ATTTTTTGTA GAGATAGTTC TCACTATATT GCTTGGGCTG
14801  GTCTCAAACT CCTGGACTCA AGTGATTCAC CTACCTCGGC CTCCCTAAGC
14851  ACTGGGATTA CAGGCTTGAG CCACCACACC CGGCAAGGAC TAGGTTTTAA
14901  AATAGGTTCC TAGGCTGGGT GTGGTGGCTT ACGCCCGTAA TCCCAGCACT
14951  TTGGGAGGCT GAGGTGGGCG GATCACGAGG TCAGGAGTTT GAGACCAGCC
15001  TGGCCAACAT AGTGAAACCC TGTCTCTACT AAAAATACAA AAAATTAGCT
15051  GGGCATAGTG GCACACACCT GTAATCCCAG CTACTCGGGA GGCTGAGGAA
15101  GGAGAATCAC TTGAACCTGG GAGGCGGAGG TTGCAGTGAG CCGAGATCAT
15151  GCCATTGCTC TCCAGCCTGG GTGACAGAGC AAGACTCCAT CTAAAAAAAA
15201  AAAAAAAGT TCCTTTGACT TCTTGACACT CTTCTCTGAG GATATTGATC
15251  ATTTTTCCCC AATAGATGTT ACTAATTGAA CACTTCTGTT GCTTCAACTT
15301  ACTAATTTAC ATGATCAATA GCCAATTAAT TCAGCAGGAG AGAATGCTAC
15351  AGAGTCGATT CTTTCTGTAC TTTCTTCTGC TCCAGAGTGA AGGATCTTTC
15401  TAAATCAGAG ACCATCACTG TGTTCACAGG GAGGGCCTAG GTGAACCTGA
15451  GATGGCAAAT GTTGCGTTTG TTCTACGGAA GAAGGGATTA TGGGTTGAAG
15501  TCCTTGGCAG TGCCAAATTG CTTAGAAAAA TGTGAAATAT GGTCCCTAGG
15551  AGTGCTCTTG GGATGTCACA TTTTTCTCAC TCCTTTGACA GGTAGATGTT
15601  ATTTTCCTGA AGGCCAGGGA AAGGATTCAG AGGGAGGAAT GAATTTGAAA
15651  GAAAATGAAG GTGACGAGAA AGAATGAGCT CATCTCCCTT ATCCTCTTTC
15701  TTCTCAAATC CTTAAGTAGC TTTGCAGTGA ACTAAGATTT GGGGGAACCT
15751  AGAGGAGGCT GAAAGTTGGA AGCTGAAATT GGCTTAGCAA GGGCAAGCTC
15801  CAAAGACAAA AGTGGAAATA GTTTGGGGGT AGCCTTTTGC ATGGGTGAAA
15851  TCCTGGTTCA TCACATCCTC CCTTATGCAA AGAGCCCTTT TATATGGGGC
15901  ATGGGGAAAA ACTGAGCTAA AGGTGATAAT TTCTCCTGAG CAAGCCAGAT
15951  GGTCAAAGCT CTAACTTCAC CATCTCCCTT GGAATGTTTA ATGTGTTCCC
16001  TGGTGTCCAG AGGCTTAACG TGTGAGAATT AAAAGCTCAA CATTTTCTTT
16051  CCCAGGGAAG GAGGAAATAG TTTTAATTGA AATCCCGGGA GGAAATGAAT
16101  GATAGTGTCA AACCAAAAAA CTTCATCTTC TGTACCACTT GCATATACTC
```

Exon 3

```
16151  CACTGACTTA CTTTCTAATC ACAGGCACAT CCCCAGGAAG CCCAGAAATG
16201  TCTACCACTC TCAAAATCAT GAGCTCCAAG GAACCCGGCA TCAGCCCAGA
16251  GATCAGGTCC ACTGTGAGAA ATTCTCCTTG GAAGACTCCA GAAACAACTG
```

TABLE 27-continued

Genomic CA125 Amino Terminal Sequence
(SEQ ID NO: 311)

```
16301  TTCCCATGGA GACCACAGTG GAACCAGTCA CCCTTCAGTC CACAGCCCTA
16351  GGAAGTGGCA GCACCAGCAT CTCTCACCTG CCCACAGGAA CCACATCACC
16401  AACCAAGTCA CCAACAGAAA ATATGTTGGC TACAGAAAGG GTCTCCCTCT
16451  CCCCATCCCC ACCTGAGGCT TGGACCAACC TTTATTCTGG AACTCCAGGA
16501  GGGACCAGGC AGTCACTGGC ACAATGTCC TCTGTCTCCC TAGAGTCACC
16551  AACTGCTAGA AGCATCACAG GGACTGGTCA GCAAAGCAGT CCAGAACTGG
16601  TTTTAAAGAC AACTGGAATG GAATTCTCTA TGTGGCATGG CTCTACTGGA
16651  GGGACCACAG GGGACACACA TGTCTCTCTG AGCACATCTT CCAATATCCT
16701  TGAAGACCCT GTAACCAGCC CAAACTCTGT GAGCTCATTG ACAGATAAAT
16751  CCAAACATAA AACCGAGACA TGGGTCAGCA CCACAGCCAT TCCCTCCACT
16801  GTCCTGAATA ATAAGATAAT GGCAGCTGAA CAACAGACAA GTCGATCTGT
16851  GGATGAGGCT TATTCATCAA CTAGTTCTTG GTCAGATCAG ACATCTGGGA
16901  GTGACATCAC CCTTGGTGCA TCTCCTGATG TCACAAACAC ATTATACATC
16951  ACCTCCACAG CACAAACCAC CTCACTAGTA TCTCTGCCCT CTGGAGACCA
17001  AGGCATTACA AGCCTCACCA ATCCCTCAGG AGGAAAAACA AGCTCTGCAT
17051  CATCTGTCAC ATCTCCTTCA ATAGGGCTTG AGACTCTGAT GGCCAATGTA
17101  AGTGCAGTGA CAAGTGACAT TGCCCCTACT GCTGGGCATC TATCTCAGAC
17151  TTCATCTCCT GCGGAAGTGA GCATCCTGGA CATAACCACA GCTCCTACTC
17201  CAGGTATCTC CACCACCATC ACCACCATGG GAACCAACTC AATCTCAACT
17251  ACCACACCCA ACCCAGAAGT GGGTATGAGT ACCATGGACA GCACCCCGGC
17301  CACAGAGAGG CACACAACTT CTACAGAACA CCCTTCCACC TGGTCTTCCA
17351  CAGCTGCATC AGATTCCTGG ACTGTCACAG ACATGACTTC AAACTTGAAA
17401  GTTGCAAGAT CTCCTGGAAC AATTTCCACA ATGCATACAA CTTCATTCTT
17451  AGCCTCAAGC ACTGAATTAG ACTCCATGTC TACTCCCCAT GGCCGTATAA
17501  CTGTCATTGG AACCAGCCTG GTCACTCCAT CCTCTGATGC TTCAGCTGTA
17551  AAGACAGAGA CCAGTACAAG TGAAAGAACA TTGAGTCCTT CAGACACAAC
17601  TGCATCTACT CCCATCTCAA CTTTTTCTCG TGTCCAGAGG ATGAGCATCT
17651  CAGTTCCTGA CATTTTAAGT ACAAGTTGGA CTCCCAGTAG TACAGAAGCA
17701  GAAGATGTGC CTGTTTCAAT GGTTTCTACA GATCATGCTA GTACAAAGAC
17751  TGACCCAAAT ATGCCCCTGT CCACTTTTCT GTTTGATTCT CTGTCCACTC
17801  TTGACTGGGA CACTGGGAGA TCTCTGTCAT CAGCCACAGC CACTACCTCA
17851  GCTCCTCAGG GGGCCACAAC TCCCCAAGAA CTCACTTTGG AAACCATGAT
17901  CAGCCCAGCT ACCTCACAGT TGCCCTTCTC TATAGGGCAC ATTACAAGTG
17951  CAGTCATACC AGCTGCAATG GCAAGGAGCT CTGGAGTTAC TTTTTCAAGA
18001  CCAGATCCCA CAAGCAAAAA GGCAGAGCAG ACTTCCACTC AGCTTCCCAC
18051  CACCACTTCT GCACATCCAG AGCAGGTGCC CAGATCAGCA GCAACAACTC
18101  TGGATGTGAT CCCACACACA GCAACAACTC CAGATGCAAC TTTTCAGAGA
18151  CAAGGGCAGA CAGCTCTTAC AACAGAGGCA AGAGCTACAT CTGACTCCTG
```

TABLE 27-continued

Genomic CA125 Amino Terminal Sequence
(SEQ ID NO: 311)

```
18201  GAATGAGAAA GAAAAATCAA CCCCAAGTGC ACCTTGGATC ACTGAGATGA
18251  TGAATTCTGT CTCAGAAGAT ACCATCAAGG AGGTTACCAG CTCCTCCAGT
18301  GTGTTAAGGA CCCTGAATAC GCTGGACATA AACTTGGAAT CTGGGACGAC
18351  TTCATCCCCA AGTTGGAAAA GCAGCCCATA TGAGAGAATT GCCCCTTCTG
18401  AGTCTACCAC AGACAAAGAG GCAATTCACC CTTCTACAAA CACAGTAGAG
18451  ACCACTGGCT GGGTCACAAG TTCCGAACAT GCTTCTCATT CCACTATCCC
18501  AGCCCACTCA GCGTCATCCA AACTCACATC TCCAGTGGTT ACAACCTCCA
18551  CCAGGGAACA AGCAATAGTT TCTATGTCAA CAACCACATG GCCAGAGTCT
18601  ACAAGGGCTA GAACAGAGCC TAATTCCTTC TTGACTATTG AACTGAGGGA
18651  CGTCAGCCCT TACATGGACA CCAGCTCAAC CACACAAACA AGTTTTATCT
18701  CTTCCCCAGG TTCCACTGCG ATCACCAAGG GGCCTAGAAC AGAAATTACC
18751  TCCTCTAAGA GAATATCCAG CTCATTCCTT GCCCAGTCTA TGAGGTCGTC
18801  AGACAGCCCC TCAGAAGCCA TCTCCAGGCT GTCTAACTTT CCTGCCATGA
18851  CAGAATCTGG AGGAATGATC CTTGCTATGC AAACAAGTCC ACCTGGCGCT
18901  ACATCACTAA GTGCACCTAC TTTGGATACA TCAGCCACAG CCTCCTGGAC
18951  AGGGACTCCA CTGGCTACGA CTCAGAGATT TACATACTCA GAGAAGACCA
19001  CTCTCTTTAG CAAAGGTCCT GAGGATACAT CACAGCCAAG CCCTCCCTCT
19051  GTGGAAGAAA CCAGCTCTTC CTCTTCCCTG GTACCTATCA ATGCTACAAC
19101  CTCGCCTTCC AATATTTTGT TGACATCACA AGGGCACAGT CCCTCCTCTA
19151  CTCCACCTGT GACCTCAGTT TTCTTGTCTG AGACCTCTGG CCTGGGGAAG
19201  ACCACAGACA TGTCGAGGAT AAGCTTGGAA CCTGGCACAA GTTTACCTCC
19251  CAATTTGAGC AGTACAGCAG GTGAGGCGTT ATCCACTTAT GAAGCCTCCA
19301  GAGATACAAA GGCAATTCAT CATTCTGCAG ACACAGCAGT GACGAATATG
19351  GAGGCAACCA GTTCTGAATA TTCTCCTATC CCAGGCCATA CAAAGCCATC
19401  CAAAGCCACA TCTCCATTGG TTACCTCCCA CATCATGGGG GACATCACTT
19451  CTTCCACATC AGTATTTGGC TCCTCCGAGA CCACAGAGAT TGAGACAGTG
19501  TCCTCTGTGA ACCAGGGACT TCAGGAGAGA AGCACATCCC AGGTGGCCAG
19551  CTCTGCTACA GAGACAAGCA CTGTCATTAC CCATGTGTCT AGTGGTGATG
19601  CTACTACTCA TGTCACCAAG ACACAAGCCA CTTTCTCTAG CGGAACATCC
19651  ATCTCAAGCC CTCATCAGTT TATAACTTCT ACCAACACAT TTACAGATGT
19701  GAGCACCAAC CCCTCCACCT CTCTGATAAT GACAGAATCT TCAGGAGTGA
19751  CCATCACCAC CCAAACAGGT CCTACTGGAG CTGCAACACA GGGTCCATAT
19801  CTCTTGGACA CATCAACCAT GCCTTACTTG ACAGAGACTC CATTAGCTGT
19851  GACTCCAGAT TTTATGCAAT CAGAGAAGAC CACTCTCATA AGCAAAGGTC
19901  CCAAGGATGT GTCCTGGACA AGCCCTCCCT CTGTGGCAGA AACCAGCTAT
19951  CCCTCTTCCC TGACACCTTT CTTGGTCACA ACCATACCTC CTGCCACTTC
20001  CACGTTACAA GGGCAACATA CATCCTCTCC TGTTTCTGCG ACTTCAGTTC
20051  TTACCTCTGG ACTGGTGAAG ACCACAGATA TGTTGAACAC AAGCATGGAA
20101  CCTGTGACCA ATTCACCTCA AAATTTGAAC AATCCATCAA ATGAGATACT
```

TABLE 27-continued

Genomic CA125 Amino Terminal Sequence
(SEQ ID NO: 311)

```
20151  GGCCACTTTG GCAGCCACCA CAGATATAGA GACTATTCAT CCTTCCATAA
20201  ACAAAGCAGT GACCAATATG GGGACTGCCA GTTCAGCACA TGTACTGCAT
20251  TCCACTCTCC CAGTCAGCTC AGAACCATCT ACAGCCACAT CTCCAATGGT
20301  TCCTGCCTCC AGCATGGGGG ACGCTCTTGC TTCTATATCA ATACCTGGTT
20351  CTGAGACCAC AGACATTGAG GGAGAGCCAA CATCCTCCCT GACTGCTGGA
20401  CGAAAAGAGA ACAGCACCCT CCAGGAGATG AACTCAACTA CAGAGTCAAA
20451  CATCATCCTC TCCAATGTGT CTGTGGGGGC TATTACTGAA GCCACAAAAA
20501  TGGAAGTCCC CTCTTTTGAT GCAACATTCA TACCAACTCC TGCTCAGTCA
20551  ACAAAGTTCC CAGATATTTT CTCAGTAGCC AGCAGTAGAC TTTCAAACTC
20601  TCCTCCCATG ACAATATCTA CCCACATGAC CACCACCCAG ACAGGGTCTT
20651  CTGGAGCTAC ATCAAAGATT CCACTTGCCT TAGACACATC AACCTTGGAA
20701  ACCTCAGCAG GGACTCCATC AGTGGTGACT GAGGGGTTTG CCCACTCAAA
20751  AATAACCACT GCAATGAACA ATGATGTCAA GGACGTGTCA CAGACAAACC
20801  CTCCCTTTCA GGATGAAGCC AGCTCTCCCT CTTCTCAAGC ACCTGTCCTT
20851  GTCACAACCT TACCTTCTTC TGTTGCTTTC ACACCGCAAT GGCACAGTAC
20901  CTCCTCTCCT GTTTCTATGT CCTCAGTTCT TACTTCTTCA CTGGTAAAGA
20951  CCGCAGGCAA GGTGGATACA AGCTTAGAAA CAGTGACCAG TTCACCTCAA
21051  AGATATAGAG ACAACGCATC CTTCCATAAA CACAGTAGTT ACCAATGTGG
21101  GGACCACCGG TTCAGCATTT GAATCACATT CTACTGTCTC AGCTTACCCA
21151  GAGCCATCTA AAGTCACATC TCCAAATGTT ACCACCTCCA CCATGGAAGA
21201  CACCACAATT TCCAGATCAA TACCTAAATC CTCTAAGACT ACAAGAACTG
21251  AGACTGAGAC AACTTCCTCC CTGACTCCTA AACTGAGGGA GACCAGCGTC
21301  TCCCAGGAGA TCACCTCGTC CACAGAGACA AGCACTGTTC CTTACAAAGA
21351  GCTCACTGGT GCCACTACCG AGGTATCCAG GACAGATGTC ACTTCCTCTA
21401  GCAGTACATC CTTCCCTGGC CCTGATCAGT CCACAGTGTC ACTAGACATC
21451  TCCACAGAAA CCAACACCAG GCTGTCTACC TCCCCAATAA TGACAGAATC
21501  TGCAGAAATA ACCATCACCA CCCAAACAGG TCCTCATGGG CTACATCAC
21551  AGGATACTTT TACCATGGAC CCATCAAATA CAACCCCCCA GGCAGGGATC
21601  CACTCAGCTA TGACTCATGG ATTTTCACAA TTGGATGTGA CCACTCTTAT
21651  GAGCAGAATT CCACAGGATG TATCATGGAC AAGTCCTCCC TCTGTGGATA
21701  AAACCAGCTC CCCCTCTTCC TTTCTGCCCT CACCTGCAAT GACCACACCT
21751  TCCCTGATTT CTTCTACCTT ACCAGAGGAT AAGCTCTCCT CTCCTATGAC
21801  TTCACTTCTC ACCTCTGGCC TAGTGAAGAT TACAGACATA TTACGTACAC
21851  GCTTGGAACC TGTGACCAGC TCACTTCCAA ATTTCAGCAG CACCTCAGAT
21901  AAGATACTGG CCACTTCTAA AGACAGTAAA GACACAAAGG AAATTTTTCC
21951  TTCTATAAAC ACAGAAGAGA CCAATGTGAA AGCCAACAAC TCTGGACATG
22001  AATCCCATTC CCCTGCACTG GCTGACTCAG AGACACCCAA AGCCACAACT
22051  CAAATGGTTA TCACCACCAC TGTGGGAGAT CCAGCTCCTT CCACATCAAT
```

TABLE 27-continued

Genomic CA125 Amino Terminal Sequence
(SEQ ID NO: 311)

```
22101  GCCAGTGCAT GGTTCCTCTG AGACTACAAA CATTAAGAGA GAGCCAACAT
22151  ATTTCTTGAC TCCTAGACTG AGAGAGACCA GTACCTCTCA GGAGTCCAGC
22201  TTTCCCACGG ACACAAGTTT CTACTTTCC AAAGTCCCCA CTGGTACTAT
22251  TACTGAGGTC TCCAGTACAG GGGTCATCTC TTCTAGCAAA ATTTCCACCC
22301  CAGACCATGA TAAGTCCACA GTGCCACCTG ACACCTTCAC AGGAGAGATC
22351  CCCAGGGTCT TCACCTCCTC TATTAAGACA AAATCTGCAG AAATGACGAT
22401  CACCACCCAA GCAAGTCCTC CTGAGTCTGC ATCGCACAGT ACCCTTCCCT
22451  TGGACACATC AACCACACTT TCCCAGGGAG GGACTCATTC AACTGTGACT
22501  CAGGGATTCC CATACTCAGA GGTGACCACT CTCATGGGCA TGGGTCCTGG
22551  GAATGTGTCA TGGATGACAA CTCCCCCTGT GGAAGAAACC AGCTCTGTGT
22601  CTTCCCTGAT GTCTTCACCT GCCATGACAT CCCCTTCTCC TGTTTCCTCC
22651  ACATCACCAC AGAGCATCCC CTCCTCTCCT CTTCCTGTGA CTGCACTTCC
22701  TACTTCTGTT CTGGTGACAA CCACAGATGT GTTGGGCACA ACAAGCCCAG
22751  AGTCTGTAAC CAGTTCACCT CCAAATTTGA GCAGCATCAC TCATGAGAGA
22801  CCGGCCACTT ACAAAGACAC TGCACACACA GAAGCCGCCA TGCATCATTC
22851  CACAAACACC GCAGTGACCA ATGTAGGGAC TTCCGGGTCT GGACATAAAT
22901  CACAATCCTC TGTCCTAGCT GACTCAGAGA CATCGAAAGC CACACCTCTG
22951  ATGAGTACCA CCTCCACCCT GGGGGACACA AGTGTTTCCA CATCAACTCC
23001  TAATATCTCT CAGACTAACC AAATTCAAAC AGAGCCAACA GCATCCCTGA
23051  GCCCTAGACT GAGGGAGAGC AGCACGTCTG AGAAGACCAG CTCAACAACA
23101  GAGACAAATA CTGCCTTTTC TTATGTGCCC ACAGGTGCTA TTACTCAGGC
23151  CTCCAGAACA GAAATCTCCT CTAGCAGAAC ATCCATCTCA GACCTTGATC
23201  GGTCCACAAT AGCACCCGAC ATCTCCACAG GAATGATCAC CAGGCTCTTC
23251  ACCTCCCCCA TCATGACAAA ATCTGCAGAA ATGACCGTCA CCACTCAAAC
23301  AACTACTCCT GGGGCTACAT CACAGGGTAT CCTTCCCTGG GACACATCAA
23351  CCACACTTTT CCAGGGAGGG ACTCATTCAA CCGTGTCTCA GGGATTCCCA
23401  CACTCAGAGA TAACCACTCT TCGGAGCAGA ACCCCTGGAG ATGTGTCATG
23451  GATGACAACT CCCCCTGTGG AAGAAACCAG CTCTGGGTTT TCCCTGATGT
23501  CACCTTCCAT GACATCCCCT TCTCCTGTTT CCTCCACATC ACCAGAGAGC
23551  ATCCCCTCCT CTCCTCTCCC TGTGACTGCA CTTCTTACTT CTGTTCTGGT
23601  GACAACCACA AATGTATTGG GCACAACAAG CCCAGAGCCC GTAACGAGTT
23651  CACCTCCAAA TTTAAGCAGC CCCACACAGG AGAGACTGAC CACTTACAAA
23701  GACACTGCGC ACACAGAAGC CATGCATGCT TCCATGCATA CAAACACTGC
23751  AGTGGCCAAC GTGGGGACCT CCATTTCTGG ACATGAATCA CAATCTTCTG
23801  TCCCAGCTGA TTCAGACACA TCCAAAGCCA CATCTCCAAT GGGTACCACC
23851  TTCGCCATGG GGGATACAAG TGTTTCTACA TCAACTCCTG CCTTCTTTGA
23901  GACTAGAATT CAGACTGAAT CAACATCCTC TTTGATTCCT GGATTAAGGG
23951  ACACCAGGAC GTCTGAGGAG ATCAACACTG TGACAGAGAC CAGCACTGTC
24001  CTTTCAGAAG TGCCCACTAC TACTACTACT GAGGTCTCCA GGACAGAAGT
```

TABLE 27-continued

Genomic CA125 Amino Terminal Sequence
(SEQ ID NO: 311)

| | |
|---|---|
| 24051 | TATCACTTCC AGCAGAACAA CCATCTCAGG GCCTGATCAT TCCAAAATGT |
| 24101 | CACCCTACAT CTCCACAGAA ACCATCACCA GGCTCTCCAC TTTTCCTTTT |
| 24151 | GTAACAGGAT CCACAGAAAT GGCCATCACC AACCAAACAG GTCCTATAGG |
| 24201 | GACTATCTCA CAGGCTACCC TTACCCTGGA CACATCAAGC ACAGCTTCCT |
| 24251 | GGGAAGGGAC TCACTCACCT GTGACTCAGA GATTTCCACA CTCAGAGGAG |
| 24301 | ACCACTACTA TGAGCAGAAG TACTAAGGGC GTGTCATGGC AAAGCCCTCC |
| 24351 | CTCTGTGGAA GAAACCAGTT CTCCTTCTTC CCCAGTGCCT TTACCTGCAA |
| 24401 | TAACCTCACA TTCATCTCTT TATTCCGCAG TATCAGGAAG TAGCCCCACT |
| 24451 | TCTGCTCTCC CTGTGACTTC CCTTCTCACC TCTGGCAGGA GGAAGACCAT |
| 24501 | AGACATGTTG GACACACACT CAGAACTTGT GACCAGCTCC TTACCAAGTG |
| 24551 | CAAGTAGCTT CTCAGGTGAG ATACTCACTT CTGAAGCCTC CACAAATACA |
| 24601 | GAGACAATTC ACTTTTCAGA GAACACAGCA GAAACCAATA TGGGGACCAC |
| 24651 | CAATTCTATG CATAAACTAC ATTCCTCTGT CTCAATCCAC TCCCAGCCAT |
| 24701 | CCGGACACAC ACCTCCAAAG GTTACTGGAT CTATGATGGA GGACGCTATT |
| 24751 | GTTTCCACAT CAACACCTGG TTCTCCTGAG ACTAAAAATG TTGACAGAGA |
| 24801 | CTCAACATCC CCTCTGACTC CTGAACTGAA AGAGGACAGC ACCGCCCTGG |
| 24851 | TGATGAACTC AACTACAGAG TCAAACACTG TTTTCTCCAG TGTGTCCCTG |
| 24901 | GATGCTGCTA CTGAGGTCTC CAGGGCAGAA GTCACCTACT ATGATCCTAC |
| 24951 | ATTCATGCCA GCTTCTGCTC AGTCAACAAA GTCCCCAGAC ATTTCACCTG |
| 25001 | AAGCCAGCAG CAGTCATTCT AACTCTCCTC CCTTGACAAT ATCTACACAC |
| 25051 | AAGACCATCG CCACACAAAC AGGTCCTTCT GGGGTGACAT CTCTTGGCCA |
| 25101 | ACTGACCCTG GACACATCAA CCATAGCCAC CTCAGCAGGA ACTCCATCAG |
| 25151 | CCAGAACTCA GGATTTTGTA GATTCAGAAA CAACCAGTGT CATGAACAAT |
| 25201 | GATCTCAATG ATGTGTTGAA GACAAGCCCT TTCTCTGCAG AAGAAGCCAA |
| 25251 | CTCTCTCTCT TCTCAGGCAC CTCTCCTTGT GACAACCTCA CCTTCTCCTG |
| 25301 | TAACTTCCAC ATTGCAAGAG CACAGTACCT CCTCTCTTGT TTCTGTGACC |
| 25351 | TCAGTACCCA CCCCTACACT GGCGAAGATC ACAGACATGG ACACAAACTT |
| 25401 | AGAACCTGTG ACTCGTTCAC CTCAAAATTT AAGGAACACC TTGGCCACTT |
| 25451 | CAGAAGCCAC CACAGATACA CACACAATGC ATCCTTCTAT AAACACAGCA |
| 25501 | GTGGCCAATG TGGGGACCAC CAGTTCACCA AATGAATTCT ATTTTACTGT |
| 25551 | CTCACCTGAC TCAGACCCAT ATAAAGCCAC ATCCGCAGTA GTTATCACTT |
| 25601 | CCACCTCGGG GGACTCAATA GTTTCCACAT CAATGCCTAG ATCCTCTGCG |
| 25651 | ATGAAAAAGA TTGAGTCTGA GACAACTTTC TCCCTGATAT TTAGACTGAG |
| 25701 | GGAGACTAGC ACCTCCCAGA AAATTGGCTC ATCCTCAGAC ACAAGCACGG |
| 25751 | TCTTTGACAA AGCATTCACT GCTGCTACTA CTGAGGTCTC CAGAACAGAA |
| 25801 | CTCACCTCCT CTAGCAGAAC ATCCATCCAA GGCACTGAAA AGCCCACAAT |
| 25851 | GTCACCGGAC ACCTCCACAA GATCTGTCAC CATGCTTTCT ACTTTTGCTG |
| 25901 | GCCTGACAAA ATCCGAAGAA AGGACCATTG CCACCCAAAC AGGTCCTCAT |

TABLE 27-continued

Genomic CA125 Amino Terminal Sequence
(SEQ ID NO: 311)

```
25951  AGGGCGACAT CACAGGGTAC CCTTACCTGG GACACATCAA TCACAACCTC
26001  ACAGGCAGGG ACCCACTCAG CTATGACTCA TGGATTTTCA CAATTAGATT
26051  TGTCCACTCT TACGAGTAGA GTTCCTGAGT ACATATCAGG GACAAGCCCA
26101  CCCTCTGTGG AAAAAACCAG CTCTTCCTCT TCCCTTCTGT CTTTACCAGC
26151  AATAACCTCA CCGTCCCCTG TACCTACTAC ATTACCAGAA AGTAGGCCGT
26201  CTTCTCCTGT TCATCTGACT TCACTCCCCA CCTCTGGCCT AGTGAAGACC
26251  ACAGATATGC TGGCATCTGT GGCCAGTTTA CCTCCAAACT TGGGCAGCAC
26301  CTCACATAAG ATACCGACTA CTTCAGAAGA CATTAAAGAT ACAGAGAAAA
26351  TGTATCCTTC CACAAACATA GCAGTAACCA ATGTGGGGAC CACCACTTCT
26401  GAAAAGGAAT CTTATTCGTC TGTCCCAGCC TACTCAGAAC CACCCAAAGT
26451  CACCTCTCCA ATGGTTACCT CTTTCAACAT AAGGGACACC ATTGTTTCCA
26501  CATCCATGCC TGGCTCCTCT GAGATTACAA GGATTGAGAT GGAGTCAACA
26551  TTCTCCCTGG CTCATGGGCT GAAGGGAACC AGCACCTCCC AGGACCCCAT
26601  CGTATCCACA GAGAAAAGTG CTGTCCTTCA CAAGTTGACC ACTGGTGCTA
26651  CTGAGACCTC TAGGACAGAA GTTGCCTCTT CTAGAAGAAC ATCCATTCCA
26701  GGCCCTGATC ATTCCACAGA GTCACCAGAC ATCTCCACTG AAGTGATCCC
26751  CAGCCTGCCT ATCTCCCTTG GCATTACAGA ATCTTCAAAT ATGACCATCA
26801  TCACTCGAAC AGGTCCTCAT CTTGGCTCTA CATCACAGGG CACATTTACC
26851  TTGGACACAC CAACTACATC CTCCAGGGCA GGAACACACT CGATGGCGAC
26901  TCAGGAATTT CCACACTCAG AAATGACCAC TGTCATGAAC AAGGACCCTG
26951  AGATTCTATC ATGGACAATC CCTCCTTCTA TAGAGAAAAC CAGCTTCTCC
27001  TCTTCCCTGA TGCCTTCACC AGCCATGACT TCACCTCCTG TTTCCTCAAC
27051  ATTACCAAAG ACCATTCACA CCACTCCTTC TCCTATGACC TCACTGCTCA
27101  CCCCTAGCCT AGTGATGACC ACAGACACAT TGGGCACAAG CCCAGAACCT
27151  ACAACCAGTT CACCTCCAAA TTTGAGCAGT ACCTCACATG AGATACTGAC
27201  AACAGATGAA GACACCACAG CTATAGAAGC CATGCATCCT TCCACAAGCA
27251  CAGCAGCGAC TAATGTGGAA ACCACCAGTT CTGGACATGG GTCACAATCC
27301  TCTGTCCTAG CTGACTCAGA AAAAACCAAG GCCACAGCTC CAATGGATAC
27351  CACCTCCACC ATGGGGCATA CAACTGTTTC CACATCAATG TCTGTTTCCT
27401  CTGAGACTAC AAAAATTAAG AGAGAGTCAA CATATTCCTT GACTCCTGGA
27451  CTGAGAGAGA CCAGCATTTC CCAAAATGCC AGCTTTTCCA CTGACACAAG
27501  TATTGTTCTT TCAGAAGTCC CCACTGGTAC TACTGCTGAG GTCTCCAGGA
27551  CAGAAGTCAC CTCCTCTGGT AGAACATCCA TCCCTGGCCC TTCTCAGTCC
27601  ACAGTTTTGC CAGAAATATC CACAAGAACA ATGACAAGGC TCTTTGCCTC
27651  GCCCACCATG ACAGAATCAG CAGAAATGAC CATCCCCACT CAAACAGGTC
27701  CTTCTGGGTC TACCTCACAG GATACCCTTA CCTTGGACAC ATCCACCACA
27751  AAGTCCCAGG CAAAGACTCA TTCAACTTTG ACTCAGAGAT TTCCACACTC
27801  AGAGATGACC ACTCTCATGA GCAGAGGTCC TGGAGATATG TCATGGCAAA
27851  GCTCTCCCTC TCTGGAAAAT CCCAGCTCTC TCCCTTCCCT GCTGTCTTTA
```

TABLE 27-continued

Genomic CA125 Amino Terminal Sequence
(SEQ ID NO: 311)

```
27901 CCTGCCACAA CCTCACCTCC TCCCATTTCC TCCACATTAC CAGTGACTAT
27951 CTCCTCCTCT CCTCTTCCTG TGACTTCACT TCTCACCTCT AGCCCGGTAA
28001 CGACCACAGA CATGTTACAC ACAAGCCCAG AACTTGTAAC CAGTTCACCT
28051 CCAAAGCTGA GCCACACTTC AGATGAGAGA CTGACCACTG GCAAGGACAC
28101 CACAAATACA GAAGCTGTGC ATCCTTCCAC AAACACAGCA GCGTCCAATG
28151 TGGAGATTCC CAGCTCTGGA CATGAATCCC CTTCCTCTGC CTTAGCTGAC
28201 TCAGAGACAT CCAAAGCCAC ATCACCAATG TTTATTACCT CCACCCAGGA
28251 GGATACAACT GTTGCCATAT CAACCCCTCA CTTCTTGGAG ACTAGCAGAA
28301 TTCAGAAAGA GTCAATTTCC TCCCTGAGCC CTAAATTGAG GGAGACAGGC
28351 AGTTCTGTGG AGACAAGCTC AGCCATAGAG ACAAGTGCTG TCCTTTCTGA
28401 AGTGTCCGTT GGTGCTACTA CTGAGATCTC CAGGACAGAA GTCACCTCCT
28451 CTAGCAGAAC ATCCATCTCT GGTTCTGCTG AGTCCACAAT GTTGCCAGAA
28501 ATATCCACCA CAAGAAAAAT CATTAAGTTC CCTACTTCCC CCATCCTGGC
28551 AGAATCATCA GAAATGACCA TCAAGACCCA AACAAGTCCT CCTGGGTCTA
28601 CATCAGAGAG TACCTTTACA TTAGACACAT CAACCACTCC CTCCTTGGTA
28651 ATAACCCATT CGACTATGAC TCAGAGATTG CCACACTCAG AGATAACCAC
28701 TCTTGTGAGT AGAGGTGCTG GGGATGTGCC ACGGCCCAGC TCTCTCCCTG
28751 TGGAAGAAAC AAGCCCTCCA TCTTCCCAGC TGTCTTTATC TGCCATGATC
28801 TCACCTTCTC CTGTTTCTTC CACATTACCA GCAAGTAGCC ACTCCTCTTC
28851 TGCTTCTGTG ACTTCACTTC TCACACCAGG CCAAGTGAAG ACTACTGAGG
28901 TGTTGGACGC AAGTGCAGAA CCTGAAACCA GTTCACCTCC AAGTTTGAGC
28951 AGCACCTCAG TTGAAATACT GGCCACCTCT GAAGTCACCA CAGATACGGA
29001 GAAAATTCAT CCTTTCTCAA ACACGGCAGT AACCAAAGTT GGAACTTCCA
29051 GTTCTGGACA TGAATCCCCT TCCTCTGTCC TACCTGACTC AGAGACAACC
29101 AAAGCCACAT CGGCAATGGG TACCATCTCC ATTATGGGGG ATACAAGTGT
29151 TTCTACATTA ACTCCTGCCT TATCTAACAC TAGGAAAATT CAGTCAGAGC
29201 CAGCTTCCTC ACTGACCACC AGATTGAGGG AGACCAGCAC CTCTGAAGAG
29251 ACCAGCTTAG CCACAGAAGC AAACACTGTT CTTTCTAAAG TGTCCACTGG
29301 TGCTACTACT GAGGTCTCCA GGACAGAAGC CATCTCCTTT AGCAGAACAT
29351 CCATGTCAGG CCCTGAGCAG TCCACAATGT CACAAGACAT CTCCATAGGA
29401 ACCATCCCCA GGATTTCTGC CTCCTCTGTC CTGACAGAAT CTGCAAAAAT
29451 GACCATCACA ACCCAAACAG GTCCTTCGGA GTCTACACTA GAAAGTACCC
29501 TTAATTTGAA CACAGCAACC ACACCCTCTT GGGTGGAAAC CCACTCTATA
29551 GTAATTCAGG GATTTCCACA CCCAGAGATG ACCACTTCCA TGGGCAGAGG
29601 TCCTGGAGGT GTGTCATGGC CTAGCCCTCC CTTTGTGAAA GAAACCAGCC
29651 CTCCATCCTC CCCGCTGTCT TTACCTGCCG TGACCTCACC TCATCCTGTT
29701 TCCACCACAT TCCTAGCACA TATCCCCCCC TCTCCCCTTC CTGTGACTTC
29751 ACTTCTCACC TCTGGCCCGG CGACAACCAC AGATATCTTG GGTACAAGCA
```

TABLE 27-continued

Genomic CA125 Amino Terminal Sequence
(SEQ ID NO: 311)

| | |
|---|---|
| 29801 | CAGAACCTGG AACCAGTTCA TCTTCAAGTT TGAGCACCAC CTCCCATGAG |
| 29851 | AGACTGACCA CTTACAAAGA CACTGCACAT ACAGAAGCCG TGCATCCTTC |
| 29901 | CACAAACACA GGAGGGACCA ATGTGGCAAC CACCAGCTCT GGATATAAAT |
| 29951 | CACAGTCCTC TGTCCTAGCT GACTCATCTC CAATGTGTAC CACCTCCACC |
| 30001 | ATGGGGGATA CAAGTGTTCT CACATCAACT CCTGCCTTCC TTGAGACTAG |
| 30051 | GAGGATTCAG ACAGAGCTAG CTTCCTCCCT GACCCCTGGA TTGAGGGAGT |
| 30101 | CCAGTGGCTC TGAAGGGACC AGCTCAGGCA CCAAGATGAG CACTGTCCTC |
| 30151 | TCTAAAGTGC CCACTGGTGC TACTACTGAG ATCTCCAAGG AAGACGTCAC |
| 30201 | CTCCATCCCA GGTCCCGCTC AATCCACAAT ATCACCAGAC ATCTCCACAA |
| 30251 | GAACCGTCAG CTGGTTCTCT ACATCCCCTG TCATGACAGA ATCAGCAGAA |
| 30301 | ATAACCATGA ACACCCATAC AAGTCCTTTA GGGGCCACAA CACAAGGCAC |
| 30351 | CAGTACTTTG GCCACGTCAA GCACAACCTC TTTGACAATG ACACACTCAA |
| 30401 | CTATATCTCA AGGATTTTCA CACTCACAGA TGAGCACTCT TATGAGGAGG |
| 30451 | GGTCCTGAGG ATGTATCATG GATGAGCCCT CCCCTTCTGG AAAAAACTAG |
| 30501 | ACCTTCCTTT TCTCTGATGT CTTCACCAGC CACAACTTCA CCTTCTCCTG |
| 30551 | TTTCCTCCAC ATTACCAGAG AGCATCTCTT CCTCTCCTCT TCCTGTGACT |
| 30601 | TCACTCCTCA CGTCTGGCTT GGCAAAAACT ACAGATATGT TGCACAAAAG |
| 30651 | CTCAGAACCT GTAACCAACT CACCTGCAAA TTTGAGCAGC ACCTCAGTTG |
| 30701 | AAATACTGGC CACCTCTGAA GTCACCACAG ATACAGAAA AACTCATCCT |
| 30751 | TCTTCAAACA GAACAGTGAC CGATGTGGGG ACCTCCAGTT CTGGACATGA |
| 30801 | ATCCACTTCC TTTGTCCTAG CTGACTCACA GACATCCAAA GTCACATCTC |
| 30851 | CAATGGTTAT TACCTCCACC ATGGAGGATA CGAGTGTCTC CACATCAACT |
| 30901 | CCTGGCTTTT TTGAGACTAG CAGAATTCAG ACAGAACCAA CATCCTCCCT |
| 30951 | GACCCTTGGA CTGAGAAAGA CCAGCAGCTC TGAGGGGACC AGCTTAGCCA |
| 31001 | CAGAGATGAG CACTGTCCTT TCTGGAGTGC CCACTGGTGC CACTGCTGAA |
| 31051 | GTCTCCAGGA CAGAAGTCAC CTCCTCTAGC AGAACATCCA TCTCAGGCTT |
| 31101 | TGCTCAGCTC ACAGTGTCAC CAGAGACTTC CACAGAAACC ATCACCAGAC |
| 31151 | TCCCTACCTC CAGCATAATG ACAGAATCAG CAGAAATGAT GATCAAGACA |
| 31201 | CAAACAGATC CTCCTGGGTC TACACCAGAG AGTACTCATA CTGTGGACAT |
| 31251 | ATCAACAACA CCCAACTGGG TAGAAACCCA CTCGACTGTG ACTCAGAGAT |
| 31301 | TTTCACACTC AGAGATGACC ACTCTTGTGA GCAGAAGCCC TGGTGATATG |
| 31351 | TTATGGCCTA GTCAATCCTC TGTGGAAGAA ACCAGCTCTG CCTCTTCCCT |
| 31401 | GCTGTCTCTG CCTGCCACGA CCTCACCTTC TCCTGTTTCC TCTACATTAG |
| 31451 | TAGAGGATTT CCCTTCCGCT TCTCTTCCTG TGACTTCTCT TCTCACCCCT |
| 31501 | GGCCTGGTGA TAACCACAGA CAGGATGGGC ATAAGCAGAG AACCTGGAAC |
| 31551 | CAGTTCCACT TCAAATTTGA GCAGCACCTC CCATGAGAGA CTGACCACTT |
| 31601 | TGGAAGACAC TGTAGATACA GAAGCATGC AGCCTTCCAC ACACACAGCA |
| 31651 | GTGACCAACG TGAGGACCTC CATTTCTGGA CATGAATCAC AATCTTCTGT |
| 31701 | CCTATCTGAC TCAGAGACAC CCAAAGCCAC ATCTCCAATG GGTACCACCT |

TABLE 27-continued

Genomic CA125 Amino Terminal Sequence
(SEQ ID NO: 311)

```
31751  ACACCATGGG GGAAACGAGT GTTTCCATAT CCACTTCTGA CTTCTTTGAG
31801  ACCAGCAGAA TTCAGATAGA ACCAACATCC TCCCTGACTT CTGGATTGAG
31851  GGAGACCAGC AGCTCTGAGA GGATCAGCTC AGCCACAGAG GAAGCACTG
31901  TCCTTTCTGA AGTGCCCAGT GGTGCTACCA CTGAGGTCTC CAGGACAGAA
31951  GTGATATCCT CTAGGGGAAC ATCCATGTCA GGGCCTGATC AGTTCACCAT
32001  ATCACCAGAC ATCTCTACTG AAGCGATCAC CAGGCTTTCT ACTTCCCCA
32051  TTATGACAGA ATCAGCAGAA AGTGCCATCA CTATTGAGAC AGGTTCTCCT
32101  GGGGCTACAT CAGAGGGTAC CCTCACCTTG GACACCTCAA CAACAACCTT
32151  TTGGTCAGGG ACCCACTCAA CTGCATCTCC AGGATTTTCA CACTCAGAGA
32201  TGACCACTCT TATGAGTAGA ACTCCTGGAG ATGTGCCATG GCCGAGCCTT
32251  CCCTCTGTGG AAGAAGCCAG CTCTGTCTCT TCCTCACTGT CTTCACCTGC
32301  CATGACCTCA ACTTCTTTTT TCTCCACATT ACCAGAGAGC ATCTCCTCCT
32351  CTCCTCATCC TGTGACTGCA CTTCTCACCC TTGGCCCAGT GAAGACCACA
32401  GACATGTTGC GCACAAGCTC AGAACCTGAA ACCAGTTCAC CTCCAAATTT
32451  GAGCAGCACC TCAGCTGAAA TATTAGCCAC GTCTGAAGTC ACCAAAGATA
32501  GAGAGAAAAT TCATCCCTCC TCAAACACAC CTGTAGTCAA TGTAGGGACT
32551  GTGATTTATA AACATCTATC CCCTTCCTCT GTTTTGGCTG ACTTAGTGAC
32601  AACAAAACCC ACATCTCCAA TGGCTACCAC CTCCACTCTG GGGAATACAA
32651  GTGTTTCCAC ATCAACTCCT GCCTTCCCAG AAACTATGAT GACACAGCCA
32701  ACTTCCTCCC TGACTTCTGG ATTAAGGGAG ATCAGTACCT CTCAAGAGAC
32751  CAGCTCAGCA ACAGAGAGAA GTGCTTCTCT TTCTGGAATG CCCACTGGTG
32801  CTACTACTAA GGTCTCCAGA ACAGAAGCCC TCTCCTTAGG CAGAACATCC
32851  ACCCCAGGTC CTGCTCAATC CACAATATCA CCAGAAATCT CCACGGAAAC
32901  CATCACTAGA ATTTCTACTC CCCTCACCAC GACAGGATCA GCAGAAATGA
32951  CCATCACCCC CAAAACAGGT CATTCTGGGG CATCCTCACA AGGTACCTTT
33001  ACCTTGGACA CATCAAGCAG AGCCTCCTGG CCAGGAACTC ACTCAGCTGC
33051  AACTCACAGA TCTCCACACT CAGGGATGAC CACTCCTATG AGCAGAGGTC
33101  CTGAGGATGT GTCATGGCCA AGCCGCCCAT CAGTGGAAAA AACTAGCCCT
33151  CCATCTTCCC TGGTGTCTTT ATCTGCAGTA ACCTCACCTT CGCCACTTTA
33201  TTCCACACCA TCTGAGAGTA GCCACTCATC TCCTCTCCGG GTGACTTCTC
33251  TTTTCACCCC TGTCATGATG AAGACCACAG ACATGTTGGA CACAAGCTTG
33301  GAACCTGTGA CCACTTCACC TCCCAGTATG AATATCACCT CAGATGAGAG
33351  TCTGGCCACT TCTAAAGCCA CCATGGAGAC AGAGGCAATT CAGCTTTCAG
33401  AAAACACAGC TGTGACTCAG ATGGGCACCA TCAGCGCTAG ACAAGAATTC
33451  TATTCCTCTT ATCCAGGCCT CCCAGAGCCA TCCAAAGTGA CATCTCCAGT
33501  GGTCACCTCT TCCACCATAA AAGACATTGT TTCTACAACC ATACCTGCTT
33551  CCTCTGAGAT AACAAGAATT GAGATGGAGT CAACATCCAC CCTGACCCCC
33601  ACACCAAGGG AGACCAGCAC CTCCCAGGAG ATCCACTCAG CCACAAAGCC
```

TABLE 27-continued

| Genomic CA125 Amino Terminal Sequence (SEQ ID NO: 311) |
| --- |

| | |
| --- | --- |
| 33651 | AAGCACTGTT CCTTACAAGG CACTCACTAG TGCCACGATT GAGGACTCCA |
| 33701 | TGACACAAGT CATGTCCTCT AGCAGAGGAC CTAGCCCTGA TCAGTCCACA |
| 33751 | ATGTCACAAG ACATATCCAG TGAAGTGATC ACCAGGCTCT CTACCTCCCC |
| 33801 | CATCAAGGCA GAATCTACAG AAATGACCAT TACCACCCAA ACAGGTTCTC |
| 33851 | CTGGGGCTAC ATCAAGGGGT ACCCTTACCT TGGACACTTC AACAACTTTT |
| 33901 | ATGTCAGGGA CCCACTCAAC TGCATCTCAA GGATTTTCAC ACTCACAGAT |
| 33951 | GACCGCTCTT ATGAGTAGAA CTCCTGGAGA TGTGCCATGG CTAAGCCATC |
| 34001 | CCTCTGTGGA AGAAGCCAGC TCTGCCTCTT TCTCACTGTC TTCACCTGTC |
| 34051 | ATGACCTCAT CTTCTCCCGT TTCTTCCACA TTACCAGACA GCATCCACTC |
| 34101 | TTCTTCGCTT CCTGTGACAT CACTTCTCAC CTCAGGGCTG GTGAAGACCA |
| 34151 | CAGAGCTGTT GGGCACAAGC TCAGAACCTG AAACCAGTTC ACCCCCAAAT |
| 34201 | TTGAGCAGCA CCTCAGCTGA AATACTGGCC ACCACTGAAG TCACTACAGA |
| 34251 | TACAGAGAAA CTGGAGATGA CCAATGTGGT AACCTCAGGT TATACACATG |
| 34301 | AATCTCCTTC CTCTGTCCTA GCTGACTCAG TGACAACAAA GGCCACATCT |
| 34351 | TCAATGGGTA TCACCTACCC CACAGGAGAT ACAAATGTTC TCACATCAAC |
| 34401 | CCCTGCCTTC TCTGACACCN NNNNNNNNNN NNNNNNNNNN NNNNNNNNNN |
| 34451 | NNNNNNNNNN NNNNNNNNNN NNNNNNNNNN NNNNNNNNNN NNNNNNNNNN |
| 34501 | NNNNNNNNNN NNNNNNNNNN NNNNNNNNNN NNNNCGGAAA CCAAGTTTCT |

| Exon 4 |
| --- |

| | |
| --- | --- |
| 34551 | AACCAACCCC TCCTTTTTGA CCCCAGTAGG ATTCAAACAA AGTCAAAGCT |
| 34601 | CTCACTGACT CCTGGGTTGA TGGAGACCAG CATCTCTGAA GAGACCAGCT |
| 34651 | CTGCCACAGA AAAAGCACT GTCCTTTCTA GTGTGCCCAC TGGTGCTACT |
| 34701 | ACTGAGGTCT CCAGGACAGA AGCCATCTCT TCTAGCAGAA CATCCATCCC |
| 34751 | AGGCCCTGCT CAATCCACAA TGTCATCAGA CACCTCCATG GAAACCATCA |
| 34801 | CTAGAATTTC TACCCCCCTC ACAAGGAAAG AATCAACAGA CATGGCCATC |
| 34851 | ACCCCCAAAA CAGGTCCTTC TGGGGCTACC TCGCAGGGTA CCTTTACCTT |
| 34901 | GGACTCATCA AGCACAGCCT CCTGGCCAGG AACTCACTCA GCTACAACTC |
| 34951 | AGAGATTTCC ACAGTCAGTG GTGACAACTC CTATGAGCAG AGGTCCTGAG |
| 35001 | GATGTGTCAT GGCCAAGCCC GCTGTCTGTG GAAAAAAACA GCCCTCCATC |
| 35051 | TTCCCTGGTA TCTTCATCTT CAGTAACCTC ACCTTCGCCA CTTTATTCCA |
| 35101 | CACCATCTGG GAGTAGCCAC TCCTCTCCTG TCCCTGTCAC TTCTCTTTTC |
| 35151 | ACCTCTATCA TGATGAAGGC CACAGACATG TTGGATGCAA GTTTGGAACC |
| 35201 | TGAGACCACT TCAGCTCCCA ATATGAATAT CACCTCAGAT GAGAGTCTGG |
| 35251 | CCACTTCTAA AGCCACCACG GAGACAGAGG CAATTCACGT TTTTGAAAAT |
| 35301 | ACAGCAGCGT CCCATGTGGA AACCACCAGT GCTACAGAGG AACTCTATTC |
| 35351 | CTCTTCCCCA GGCTTCTCAG AGCCAACAAA AGTGATATCT CCAGTGGTCA |
| 35401 | CCTCTTCCTC TATAAGAGAC AACATGGTTT CCACAACAAT GCCTGGCTCC |
| 35451 | TCTGGCATTA CAAGGATTGA GATAGAGTCA ATGTCATCTC TGACCCCTGG |
| 35501 | ACTGAGGGAG ACCAGAACCT CCCAGGACAT CACCTCATCC ACAGAGACAA |

TABLE 27-continued

Genomic CA125 Amino Terminal Sequence
(SEQ ID NO: 311)

```
35551  GCACTGTCCT TTACAAGATG TCCTCTGGTG CCACTCCTGA GGTCTCCAGG
35601  ACAGAAGTTA TGCCCTCTAG CAGAACATCC ATTCCTGGCC CTGCTCAGTC
35651  CACAATGTCA CTAGACATCT CCGATGAAGT TGTCACCAGG CTGTCTACCT
35701  CTCCCATCAT GACAGAATCT GCAGAAATAA CCATCACCAC CCAAACAGGT
35751  TATTCTCTGG CTACATCCCA GGTTACCCTT CCCTTGGGCA CCTCAATGAC
35801  CTTTTTGTCA GGGACCCACT CAACTATGTC TCAAGGACTT TCACACTCAG
35851  AGATGACCAA TCTTATGAGC AGGGGTCCTG AAAGTCTGTC ATGGACGAGC
35901  CCTCGCTTTG TGGAAACAAC TAGATCTTCC TCTTCTCTGA CATCATTACC
35951  TCTCACGACC TCACTTTCTC CTGTGTCCTC CACATTACTA GACAGTAGCC
36001  CCTCCTCTCC TCTTCCTGTG ACTTCACTTA TCCTCCCAGG CCTGGTGAAG
36051  ACTACAGAAG TGTTGGATAC AAGCTCAGAG CCTAAAACCA GTTCATCTCC
36101  AAATTTGAGC AGCACCTCAG TTGAAATACC GGCCACCTCT GAAATCATGA
36151  CAGATACAGA GAAAATTCAT CCTTCCTCAA ACACAGCGGT GGCCAAAGTG
36201  AGGACCTCCA GTTCTGTTCA TGAATCTCAT TCCTCTGTCC TAGCTGACTC
36251  AGAAACAACC ATAACCATAC CTTCAATGGG TATCACCTCC GCTGTGGACG
36301  ATACCACTGT TTTCACATCA AATCCTGCCT TCTCTGAGAC TAGGAGGATT
36351  CCGACAGAGC CAACATTCTC ATTGACTCCT GGATTCAGGG AGACTAGCAC
36401  CTCTGAAGAG ACCACCTCAA TCACAGAAAC AAGTGCAGTC CTTTATGGAG
36451  TGCCCACTAG TGCTACTACT GAAGTCTCCA TGACAGAAAT CATGTCCTCT
36501  AATAGAACAC ACATCCCTGA CTCTGATCAG TCCACGATGT CTCCAGACAT
36551  CATCACTGAA GTGATCACCA GGCTCTCTTC CTCATCCATG ATGTCAGAAT
36601  CAACACAAAT GACCATCACC ACCCAAAAAA GTTCTCCTGG GGCTACAGCA
36651  CAGAGTACTC TTACCTTGGC CACAACAACA GCCCCCTTGG CAAGGACCCA
36701  CTCAACTGTT CCTCCTAGAT TTTTACACTC AGAGATGACA ACTCTTATGA
36751  GTAGGAGTCC TGAAAATCCA TCATGGAAGA GCTCTCCCTT TGTGGAAAAA
36801  ACTAGCTCTT CATCTTCTCT GTTGTCCTTA CCTGTCACGA CCTCACCTTC
36851  TGTTTCTTCC ACATTACCGC AGAGTATCCC TTCCTCCTCT TTTTCTGTGA
36901  CTTCACTCCT CACCCCAGGC ATGGTGAAGA CTACAGACAC AAGCACAGAA
36951  CCTGGAACCA GTTTATCTCC AAATCTGAGT GGCACCTCAG TTGAAATACT
37001  GGCTGCCTCT GAAGTCACCA CAGATACAGA GAAAATTCAT CCTTCTTCAA
37051  GCATGGCAGT GACCAATGTG GGAACCACCA GTTCTGGACA TGAACTATAT
37101  TCCTCTGTTT CAATCCACTC GGAGCCATCC AAGGCTACAT ACCCAGTGGG
37151  TACTCCCTCT TCCATGGCTG AAACCTCTAT TTCCACATCA ATGCCTGCTA
37201  ATTTTGAGAC CACAGGATTT GAGGCTGAGC CATTTTCTCA TTTGACTTCT
37251  GGATTTAGGA AGACAAACAT GTCCCTGGAC ACCAGCTCAG TCACACCAAC
37301  AAATACACCT TCTTCTCCTG GGTCCACTCA CCTTTTACAG AGTTCCAAGA
37351  CTGATTTCAC CTCTTCTGCA AAAACATCAT CCCCAGACTG GCCTCCAGCC
37401  TCACAGTATA CTGAAATTCC AGTGGACATA ATCACCCCCT TTAATGCTTC
```

TABLE 27-continued

Genomic CA125 Amino Terminal Sequence
(SEQ ID NO: 311)

| | |
|---|---|
| 37451 | TCCATCTATT ACGGAGTCCA CTGGGATAAC CTCCTTCCCA GAATCCAGGT |
| 37501 | TTACTATGTC TGTAACAGAA AGTACTCATC ATCTGAGTAC AGATTTGCTG |
| 37551 | CCTTCAGCTG AGACTATTTC CACTGGCACA GTGATGCCTT CTCTATCAGA |
| 37601 | GGCCATGACT TCATTTGCCA CCACTGGAGT TCCACGAGCC ATCTCAGGTT |
| 37651 | CAGGTAGTCC ATTCTCTAGG ACAGAGTCAG GCCCTGGGGA TGCTACTCTG |
| 37701 | TCCACCATTG CAGAGAGCCT GCCTTCATCC ACTCCTGTGC CATTCTCCTC |
| 37751 | TTCAACCTTC ACTACCACTG ATTCTTCAAC CATCCCAGCC CTCCATGAGA |
| 37801 | TAACTTCCTC TTCAGCTACC CCATATAGAG TGGACACCAG TCTTGGGACA |
| 37851 | GAGAGCAGCA CTACTGAAGG ACGCTTGGTT ATGGTCAGTA CTTTGGACAC |
| 37901 | TTCAAGCCAA CCAGGCAGGA CATCTTCAAC ACCCATTTTG GATACCAGAA |
| 37951 | TGACAGAGAG CGTTGAGCTG GGAACAGTGA CAAGTGCTTA TCAAGTTCCT |
| 38001 | TCACTCTCAA CACGGTTGAC AAGAGAATGC GCATGGCGAG AAGGGAGAAG |
| 38051 | TGTAGTTGGA TGGATAAAAG GAAGAATGGA GAGAAGAGTG AATGGAAGGA |
| 38101 | AGCAAAGATG AAGCGGAGGA AGGATAGATG CACAGAAGGA AGGATGAAAA |
| 38151 | GAAAGAAAGA TGATGGAAGA CAGGATTGAA GGGGATATAG ATTGAAGGAA |
| 38201 | AGAAGGTAG AAGGATGAAA TGAAGTAAAG ATTGAAGAAA AGATGGATGG |
| 38251 | AAAGAAGAAA GGAGGGTGCA CAAAAAATCT CACACTTCAC CACATATGAT |
| 38301 | TCATCCATAT AAGAAAAAAC CACTTGTACC CTCAAAGCTA TTGAAATACA |
| 38351 | AACTTTTAAA TTAAAATTTT AAAAGCAAG AGAAGGAAA GAAGGGAGGA |
| 38401 | AAGACAAAAG GAAGAATGGG TGATAGAAGG AAAGAATAAA AGGAAGAAAA |
| 38451 | AATGGAAGAA TAGATGATCA GATCTAGGGA TGAATGAAAG GAAGGATGGA |
| 38501 | CAAATCTATA GGTAGGTGGA TGGATCTATG GACAGGTGTG GCCACTTATG |
| 38551 | GCACATAGTC CCAGCTCCAG TTCATACTGA TGGACTTGAG GAGTGTTTGT |
| 38601 | GGCCAATGAA GTGGATCCAT TTAGACAGTG CTCTTCTTCT GAATGAGATG |

Exon 5

| | |
|---|---|
| 38651 | AGTTACCCCA GTTTTTCTCC CCACCTTCAT CTTCAGGAC TGATGGCATT |
| 38701 | ATGGAACACA TCACAAAAAT ACCCAATGAA GCAGCACACA GAGGTACCAT |
| 38751 | AAGACCAGTC AAAGGCCCTC AGACATCCAC TTCGCCTGCC AGTCCTAAAG |
| 38801 | GTAGGTTTAA CTTTGCTTAC CTCCCAGTAA TGCCACTCGT GACCATATTT |
| 38851 | CCTCCTCCAG AGAGACAAAA TGTTTGTATT CTTTAGAGAG AGAATTGTGT |
| 38901 | GTGGTTGTCA TAGGTTTCCC TGTCTGAACT GAGTCTTTAT CTAATGGTTA |
| 38951 | CCAGGCAGAT GTTACCACTG TCTCTTTCTC CTCATGGCAT GCTGAGTGAG |
| 39001 | TTTTGTCCAA CATCAAATAT TCACAAATTT GTCCATATTA ACCAAATTTT |
| 39051 | AAAAATGCTC ATTAAAAACT TACTATGAGC TGGGCGCAGT GGCTCATGCC |
| 39101 | TGTAATCCCA ATACTTTGGG AGGCTGAGCT GGGTGGATCA CCAGAGGTCA |
| 39151 | AAAATTCGAG ACCAGTCTGA CCAAAATGGT GAAACTCCAT CTCTACTGAA |
| 39201 | AATATAAAAA TTAGCCGGGC ATGGTGGCAC ACACCGTAAT CACAGCTACT |
| 39251 | CAGGAGGCTG AGGCAAGAGA GTCACTTGAA CCACAGGAGG TAGAGGCTGC |
| 39301 | AGTGAGCTGA GCATTGTGCC AATGCACTCC AGCCTGGGTG GCAGAGCAAG |

TABLE 27-continued

Genomic CA125 Amino Terminal Sequence
(SEQ ID NO: 311)

| | |
|---|---|
| 39351 | ACTCCAGCTC AGAAATAAAT AATATATTAT ATATATATAT ATATGTTTTA |
| 39401 | TTTAGATGGA ATATACTATA TATATATGTA TATATATATG TATGTATATA |
| 39451 | TATATATGTA TGTATATATA TATATATATA TATATATATA TATATAGAGA |
| 39501 | GAGAGAGAGA GAGAGAGAGA GAGAGAGACA GAGTATGTCT GAGAATGCAT |
| 39551 | CCCGATAGTT CTAGCAAGGT AGGAAAAGGA AGTATCATAA CAGCCTTGAA |
| 39601 | GTAGCCTGTT GAAACAGACA GACTCTCTTG TAAGAGAACT CACAAAATCT |
| 39651 | AGGATTATAT CTCCCATGAT GAAAAATTTG GAACTGTACA TTTTTGTTTA |
| 39701 | ACTGTCACTT AAATNNNNNN NNNNNNNNNN NNNNNNNNNN NNNNNNNNNN |
| 39751 | NNNNNNNNNN NNNNNNNNNN NCCAGGAGGC ACTGTGCTTG GCGCCTTTTT |
| 39801 | ACCAACACTT TGAGATGGCC ATTGTACTTA TCCCCACTTT ATAGACGGGA |
| 39851 | AAATGGAGGT CCAGCAATAT TTTTTAACTT AAAGAGCCAC CCATCTCTTT |
| 39901 | AGAGAAAGAG CCAGAATCCC AGGCAGGGGC TATCTTATTC CAGAGCCCAA |
| 39951 | GCTCTCAAAC ACATGATACA CAATACTTAA TCTCTCTCAA GTCAGAGGAG |
| 40001 | ATCCACTTAA GTATACATCC ATCCACATAT TCATTCATTC AATCATTCAA |
| 40051 | CAAATATTAG TTGAGCACTT ACCGTATGCC AAACAGTCAA ACGTGAATAG |
| 40101 | CTGTTACAAA TGAGACTGTG AAGGATGGTA CAACGCAGAT TCAGACAGTG |
| 40151 | TGATAAGGAA ATATTGAGAA GCAAAGATGA GTTCTGGAGT GAATTTGTAA |
| 40201 | AGGTGGATGT GGGCTTGGAT TTCAATAATG CAGAACTTA AGGAATCTGA |
| 40251 | TGAGAAGTGG GCACTTCAGG CAGAGAGAAG AGCTTGAACA AGGCTCAGAG |
| 40301 | GCTGACAGTG CAGGAAACAC ATGGGAAGAG GGAATAGAGT AGCGGTCAAG |
| 40351 | AATTCACAGA GGAGTTATAG GTGAAGATGC AACCAAGTTA CAGACCAAGG |
| 40401 | TAAGATAGGG GAATACCAAT CACAATCTCT TTTCCCATTC CAGAAGCATC |
| 40451 | CCAGACACAT CCTAGTAACC GAGAGACATT TCTCTCCCTT TCCTCCTGTG |
| 40501 | GAGAATAAAT AAGCTATTGC AAGTCCAGTA AGTGTAATCA TTTTGTTCAA |

Exon 6

| | |
|---|---|
| 40551 | ATTGTGTGCC CATTCCCCAA TTTACAG<u>GAC TACACACAGG AGGGACAAAA</u> |
| 40601 | <u>AGAATGGAGA CCACAACCAC AGCTCTGAAG ACCACCACCA CAGCTCTGAA</u> |
| 40651 | <u>GACCACTTCC AGAGCCACCT TGACCACCAG TGTCTATACT CCCACTTTGG</u> |
| 40701 | <u>GAACACTGAC TCCCCTCAAT GCATCAATGC AAATGGCCAG CACAATCCCC</u> |
| 40751 | <u>ACAGAAATGA TGATCACAAC CCCATATGTT TTCCCTGATG TTCCAGAAAC</u> |
| 40801 | <u>GACATCCTCA TTGGCTACCA GCCTGGGAGC AGAAACCAGC ACAGCTCTTC</u> |
| 40851 | <u>CCAGGACAAC CCCATCTGTT TTCAATAGAG AATCAGAGAC CACAGCCTCA</u> |
| 40901 | <u>CTGGTCTCTC GTTCTGGGGC AGAGAGAAGT CCGGTTATTC AAACTCTAGA</u> |
| 40951 | <u>TGTTTCTTCT AGTGAGCCAG ATACAACAGC TTCATGGGTT ATCCATCCTG</u> |
| 41001 | <u>CAGAGACCAT CCCAACTGTT TCCAAGACAA CCCCCAATTT TTTCCACAGT</u> |
| 41051 | <u>GAATTAGACA CTGTATCTTC CACAGCCACC AGTCATGGGG CAGACGTCAG</u> |
| 41101 | <u>CTCAGCCATT CCAACAAATA TCTCACCTAG TGAACTAGAT GCACTGACCC</u> |
| 41151 | <u>CACTGGTCAC TATTTCGGGG ACAGATACTA GTACAACATT CCCAACACTG</u> |

TABLE 27-continued

Genomic CA125 Amino Terminal Sequence
(SEQ ID NO: 311)

```
41201  ACTAAGTCCC CACATGAAAC AGAGACAAGA ACCACATGGC TCACTCATCC

41251  TGCAGAGACC AGCTCAACTA TTCCCAGAAC AATCCCCAAT TTTTCTCATC

41301  ATGAATCAGA TGCCACACCT TCAATAGCCA CCAGTCCTGG GGCAGAAACC

41351  AGTTCAGCTA TTCCAATTAT GACTGTCTCA CCTGGTGCAG AAGATCTGGT

41401  GACCTCACAG GTCACTAGTT CTGGGACAGA CAGAAATATG ACTATTCCAA

41451  CTTTGACTCT TTCTCCTGGT GAACCAAAGA CGATAGCCTC ATTAGTCACC

41501  CATCCTGAAG CACAGACAAG TTCGGCCATT CCAACTTCAA CTATCTCGCC

41551  TGCTGTATCA CGGTTGGTGA CCTCAATGGT CACCAGTTTG GCGGCAAAGA

41601  CAAGTACAAC TAATCGAGCT CTGACAAACT CCCCTGGTGA ACCAGCTACA

41651  ACAGTTTCAT TGGTCACGCA TCCTGCACAG ACCAGCCCAA CAGTTCCCTG

41701  GACAACTTCC ATTTTTTTCC ATAGTAAATC AGACACCACA CCTTCAATGA

41751  CCACCAGTCA TGGGGCAGAA TCCAGTTCAG CTGTTCCAAC TCCAACTGTT

41801  TCAACTGAGG TACCAGGAGT AGTGACCCCT TTGGTCACCA GTTCTAGGGC

41851  AGTGATCAGT ACAACTATTC CAATTCTGAC TCTTTCTCCT GGTGAACCAG

41901  AGACCACACC TTCAATGGCC ACCAGTCATG GGGAAGAAGC CAGTTCTGCT

41951  ATTCCAACTC CAACTGTTTC ACCTGGGGTA CCAGGAGTGG TGACCTCTCT

42001  GGTCACTAGT TCTAGGGCAG TGACTAGTAC AACTATTCCA ATTCTGACTT

42051  TTTCTCTTGG TGAACCAGAG ACCACACCTT CAATGGCCAC CAGTCATGGG

42101  ACAGAAGCTG GCTCAGCTGT TCCAACTGTT TTACCTGAGG TACCAGGAAT

42151  GGTGACCTCT CTGGTTGCTA GTTCTAGGGC AGTAACCAGT ACAACTCTTC

42201  CAACTCTGAC TCTTTCTCCT GGTGAACCAG AGACCACACC TTCAATGGCC

42251  ACCAGTCATG GGGCAGAAGC CAGCTCAACT GTTCCAACTG TTTCACCTGA

42301  GGTACCAGGA GTGGTGACCT CTCTGGTCAC TAGTTCTAGT GGAGTAAACA

42351  GTACAAGTAT TCCAACTCTG ATTCTTTCTC CTGGTGAACT AGAAACCACA

42401  CCTTCAATGG CCACCAGTCA TGGGGCAGAA GCCAGCTCAG CTGTTCCAAC

42451  TCCAACTGTT TCACCTGGGG TATCAGGAGT GGTGACCCCT CTGGTCACTA

42501  GTTCCAGGGC AGTGACCAGT ACAACTATTC CAATTCTAAC TCTTTCTTCT

42551  AGTGAGCCAG AGACCACACC TTCAATGGCC ACCAGTCATG GGGTAGAAGC

42601  CAGCTCAGCT GTTCTAACTG TTTCACCTGA GGTACCAGGA ATGGTGACCT

42651  CTCTGGTCAC TAGTTCTAGA GCAGTAACCA GTACAACTAT TCCAACTCTG

42701  ACTATTTCTT CTGATGAACC AGAGACCACA ACTTCATTGG TCACCCATTC

42751  TGAGGCAAAG ATGATTTCAG CCATTCCAAC TTTAGCTGTC TCCCCTACTG

42801  TACAAGGGCT GGTGACTTCA CTGGTCACTA GTTCTGGGTC AGAGACCAGT

42851  GCGTTTTCAA ATCTAACTGT TGCCTCAAGT CAACCAGAGA CCATAGACTC

42901  ATGGGTCGCT CATCCTGGGA CAGAAGCAAG TTCTGTTGTT CCAACTTTGA

42951  CTGTCTCCAC TGGTGAGCCG TTTACAAATA TCTCATTGGT CACCCATCCT

43001  GCAGAGAGTA GCTCAACTCT TCCCAGGACA ACCTCAAGGT TTTCCCACAG

43051  TGAATTAGAC ACTATGCCTT CTACAGTCAC CAGTCCTGAG GCAGAATCCA

43101  GCTCAGCCAT TTCAACAACT ATTTCACCTG GTATACCAGG TGTGCTGACA
```

TABLE 27-continued

Genomic CA125 Amino Terminal Sequence
(SEQ ID NO: 311)

```
43151  TCACTGGTCA CTAGCTCTGG GAGAGACATC AGTGCAACTT TTCCAACAGT
43201  GCCTGAGTCC CCACATGAAT CAGAGGCAAC AGCCTCATGG GTTACTCATC
43251  CTGCAGTCAC CAGCACAACA GTTCCCAGGA CAACCCCTAA TTATTCTCAT
43301  AGTGAACCAG ACACCACACC ATCAATAGCC ACCAGTCCTG GGGCAGAAGC
43351  CACTTCAGAT TTTCCAACAA TAACTGTCTC ACCTGATGTA CCAGATATGG
43401  TAACCTCACA GGTCACTAGT TCTGGGACAG ACACCAGTAT AACTATTCCA
43451  ACTCTGACTC TTTCTTCTGG TGAGCCAGAG ACCACAACCT CATTTATCAC
43501  CTATTCTGAG ACACACACAA GTTCAGCCAT TCCAACTCTC CCTGTCTCCC
43551  CTGGTGCATC AAAGATGCTG ACCTCACTGG TCATCAGTTC TGGGACAGAC
43601  AGCACTACAA CTTTCCCAAC ACTGACGGAG ACCCCATATG AACCAGAGAC
43651  AACAGCCATA CAGCTCATTC ATCCTGCAGA GACCAACACA ATGGTTCCCA
43701  GGACAACTCC CAAGTTTTCC CATAGTAAGT CAGACACCAC ACTCCCAGTA
43751  GCCATCACCA GTCCTGGGCC AGAAGCCAGT TCAGCTGTTT CAACGACAAC
43801  TATCTCACCT GATATGTCAG ATCTGGTGAC CTCACTGGTC CCTAGTTCTG
43851  GGACAGACAC CAGTACAACC TTCCCAACAT TGAGTGAGAC CCCATATGAA
43901  CCAGAGACTA CAGCCACGTG GCTCACTCAT CCTGCAGAAA CCAGCACAAC
43951  GGTTTCTGGG ACAATTCCCA ACTTTTCCCA TAGGGGATCA GACACTGCAC
44001  CCTCAATGGT CACCAGTCCT GGAGTAGACA CGAGGTCAGG TGTTCCAACT
44051  ACAACCATCC CACCCAGTAT ACCAGGGGTA GTGACCTCAC AGGTCACTAG
44101  TTCTGCAACA GACACTAGTA CAGCTATTCC AACTTTGACT CCTTCTCCTG
44151  GTGAACCAGA GACCACAGCC TCATCAGCTA CCCATCCTGG GACACAGACT
44201  GGCTTCACTG TTCCAATTCG GACTGTTCCC TCTAGTGAGC CAGATACAAT
44251  GGCTTCCTGG GTCACTCATC CTCCACAGAC CAGCACACCT GTTTCCAGAA
44301  CAACCTCCAG TTTTTCCCAT AGTAGTCCAG ATGCCACACC TGTAATGGCC
44351  ACCAGTCCTA GGACAGAAGC CAGTTCAGCT GTACTGACAA CAATCTCACC
44401  TGGTGCACCA GAGATGGTGA CTTCACAGAT CACTAGTTCT GGGGCAGCAA
44451  CCAGTACAAC TGTTCCAACT TTGACTCATT CTCCTGGTAT GCCAGAGACC
44501  ACAGCCTTAT TGAGCACCCA TCCCAGAACA GAGACAAGTA AAACATTTCC
44551  TGCTTCAACT GTGTTTCCTC AAGTATCAGA GACCACAGCC TCACTCACCA
44601  TTAGACCTGG TGCAGAGACT AGCACAGCTC TCCCAACTCA GACAACATCC
44651  TCTCTCTTCA CCCTACTTGT AACTGGAACC AGCAGAGTTG ATCTAAGTCC
44701  AACTGCTTCA CCTGGTGTTT CTGCAAAAAC AGCCCCACTT TCCACCCATC
44751  CAGGGACAGA AACCAGCACA ATGATTCCAA CTTCAACTCT TTCCCTTGGT
44801  TTACTAGAGA CTACAGGCTT ACTGGCCACC AGCTCTTCAG CAGAGACCAG
44851  CACGAGTACT CTAACTCTGA CTGTTTCCCC TGCTGTCTCT GGGCTTTCCA
44901  GTGCCTCTAT AACAACTGAT AAGCCCCAAA CTGTGACCTC CTGGAACACA
44951  GAAACCTCAC CATCTGTAAC TTCAGTTGGA CCCCCAGAAT TTTCCAGGAC
45001  TGTCACAGGC ACCACTATGA CCTTGATACC ATCAGAGATG CCAACACCAC
```

TABLE 27-continued

Genomic CA125 Amino Terminal Sequence
(SEQ ID NO: 311)

```
45051  CTAAAACCAG TCATGGAGAA GGAGTGAGTC CAACCACTAT CTTGAGAACT
45101  ACAATGGTTG AAGCCACTAA TTTAGCTACC ACAGGTTCCA GTCCCACTGT
45151  GGCCAAGACA ACAACCACCT TCAATACACT GGCTGGAAGC CTCTTTACTC
45201  CTCTGACCAC ACCTGGGATG TCCACCTTGG CCTCTGAGAG TGTGACCTCA
45251  AGAACAAGTA AGAATAACTT TTTTATTGTG GTAAAATATA AATACTATAA
45301  AAATTGCCAT TCTAAACATT TTAATTGTAC AACTCAGCAG TACTAATACA
45351  TTCACATTGT TGTGCAACCC TCACCACTAT CTGTTTTCAA AACTTTTTTT
45401  ATCACCCCAA ACAGGACTGA AGGAATAATT TCCCATTCCC CATTCTCCCT
45451  AGTGCAGTGG TGCAATCTCG GCTCACCACA ACCTCTGAAC CTCTGTCTCC
45501  TGGGTTCAAG CAATTCTCCT GCATCAGCCT CCTGAGTAGT TGGGACTACA
45551  GGTGCACGCC ACCGTGCCTG GCTAATTTTT GTATTTTTAG TACAGACAGG
45601  GTTTTACCAT GTTGGTCAGG CTGGTCTCAA ACTCCTGACC TCAGGTGGTC
45651  CACACGCCTT GGCCTCCCAA AGTGCTGGGA TTACAAGTGT GAGACACTGT
45701  GCCCGGCCAT ATCTGTTAGA TCTTACTAAT CCTGTCAAGA GGATTCAGTG
45751  TCCTTTTTTT TTTTCTTTC TTTTTTTGA TAGAGTCTCC CTCTGGCACC
45801  CAGGCTGGAG TGCAGTGGTA CGGTCTTGGC TCACTGCAGC CTCCACCTCC
45851  CAGACTGAAG CGATTCTCCT GCCTCAGCCT CCCGAATAGC TGGGACTACA
45901  GGCGCGTGCC ACCACGCCCA GCTAATTTTT GCATTTTTAG TAGAGATGGG
45951  ATTTCACTAT GTTGGCCAGG CTGGTCTCAA ACTCCTGATC TCAAGTGATC
46001  CGCCCAAGGG CCTCCCAAAG TACTGGGATT ACAGGTAGGA GCCACCTCAC
46051  CTGGCCCTAT TTTCGGAATG GATTTTTTTT TAATGTTTAA AATGTCACCT
46101  AAGATTATTG TGAAGATCAA ATAAGATAAA ATCCTAATAA CCCAAGTAAA
46151  CCACAGGGCT CCACTTGGAC CAGTCTCAGA AGTTTCAAGA AAATCAGTCA
46201  GACCATCAAA TGTAAAATAA GTCTAAATTT TCTTTGCACT ATTCACAGAG
46251  TGCCAAAGAG GATCTAATTC ATGTTTCAGA ACATACCCTA CTTACTAAAA
46301  TCCCCTTTTC CTCATTTCTT CTCATTCTGC AACTTTATCA TCTCCTGCGG
46351  ACCCCCTAGC CTCTCCCCTC CCCATAGTCA GTCTCTCTCT CTCTCTTTCC
46401  CTCCCCTCTT ATTATCTCAA TTTCACACGA AAGAATTCCA GAAACTATAC
46451  TGCCAAAAGT CTTTCCTGTC TTTGAAAAGT TGGGAAAGAG GAGAAACTCA
46501  GACAGCAATG ACAAAATTAT ACGTAATGGA TGAAGGAAAC ACAAATAAGG
46551  CTGGAAACAG AAAATTTTGT CCCCATCATT TATTTAATGA AGGTGGCAGT
46601  ATTCCAGCCA CATAGTGAAC CCCCACAATA AGAAGGGGCC TCTGGCGATT
46651  GATTATTGTC ATTGTTGTTA ATGATAATGA GGGTGAGGAT ATCATGAGCA
46701  TCAGTGTAGG AGGCAGTTAA CTAATAAGAC CAAGCTGTTG GCTGGGCGTG
46751  CTGGTTCACA CCTGCAGTCC CAGCACTTTG GGAGGCCAAA GTGGGTGGAT
46801  CACTTGAGGT CAGGAGTTCA AGACTAGCCT GGCCAACATG GTGAAACCTG
46851  GTCTCTACCA AAAATACAAA AATTAGTCAG GTGTGGTGGC GTGTGCCTGT
46901  AATGACAACT ACTTGGGAGG CTGAGGCAGG AGAATCACTT GAACCTGGGA
46951  GGCGGAGGCT GCAGTGAGAT GAGCTTGAAC CACTGCACTC CAGCCCGGGC
```

TABLE 27-continued

Genomic CA125 Amino Terminal Sequence
(SEQ ID NO: 311)

| | |
|---|---|
| 47001 | AACAGAGAGA GACTCTTGTC TCAAAAAACA AAACAAACAA ACAAAAACTA |
| 47051 | AACCAAACAA AAAAAGACTA GCTGTTATTC ATTTATTTAT TTATTTATTT |
| 47101 | AGAGACGGAG TCTCGCTCTG TCACCCAGGC TGGAGTGCAG CGGCACAATC |
| 47151 | TTGGCTCACT GCAACCTCTG CCTCCCAGGT TCATGTGATT CTCCCGCCTC |
| 47201 | AGCCTCCCCA GCTGTTGTTA TTCATGAATG AACCTCAGAG AAAGCACACA |
| 47251 | GGAGGGTTGG TGCACCTGTG TTTTGAGTTC TACCCCTCCT TCCTCTCTTA |
| 47301 | ACTTCCTCCT GTCTTCTCAC TCTGATTCGT TCTTCCTTCC TCTCCCTCTC |

Exon 7

| | |
|---|---|
| 47351 | TCTCTGCAGG TTATAACCAT CGGTCCTGGA TCTCCACCAC CAGCAGTGAG |
| 47401 | TAAACATGGC CCTGAAGTCC CTATGCCCTG GGAATTCTTC CTCCCTAAGC |
| 47451 | CTGCCTTCCA GGAGGAAAGT ATCCCCCATT CCCTAGGTTC TCATCCCCAC |
| 47501 | AGAAACTCCA GAATAGCAAA AGTCTCAGGC TGAGCCAAGG CACAGATGCC |
| 47551 | AGTGCTCACC AAGAGTCCTA TTCTCCCCTC GCTAAATGAT AGGACCCAAC |
| 47601 | AAACCCGATT CACGCTGCGT TTTCTTTCAG CTCCGATGAC CTCCATGTTC |
| 47651 | TCTCCAAGGC CTCTCGTATC TGTGAGCCCC ACCCCCAGCG CTACAGGTAG |
| 47701 | GAATCTGGCT TCCAGCTCCC ATGAAACGTC GGCTGCCATT CAGTGGCTGA |
| 47751 | TTAATTGCTG TGTGGTCTGA GTCCTGATGC CCACCAAGTC TCAGCGTGTT |
| 47801 | CCCCTCTGTC AATCTCATC CAACAATTTA AGCTAATGCT TGTTTAATGA |
| 47851 | TGTCCTCACT ATACCACCTT GGACACTTTC TTTTTGCCTG GATTTAAAGC |
| 47901 | TTCCATTTCT TTCCTTCCTT CCTTCTTTTC TTCCTTCCTT CCTTCCTTCC |
| 47951 | TTCCTTCCTT CCTTCCTTCC TTCCTTCCTT CCTTCCTTCC TCCTTCCTTC |
| 48001 | CTTCCTTTCT TCCTTTCTTC CTGTCTTTTT CTTTCTTTCC TTCTTTTGGC |
| 48051 | AGAGTCTCAC TCTGTCGCCC AGGCTGGAGT GCAATGGTGC AATCTCGGTT |
| 48101 | CACTGCAACC TCTGCCTCCC AGGTTCAAGC GATTCTCATG CCACATGCCA |
| 48151 | CTATGCCTGG CTAATTTTTG TTTTTTTGTT TTTTGGGGGG TTTTTTGAGA |
| 48201 | CAGAGTCTCA GTCTGTTGCC CAAGCTGGAG TGCAGTGGCA TGATCTCGGG |
| 48251 | TCACTGCAAC CTCCTTCTCC CAGGTTCAAG CGATTTTCCT GCCTCAGCCT |
| 48301 | CCTGAGTAGC TGGAACTACA GGCACGCACC ATCACACCGG CTAATTTTTT |
| 48351 | GTGTTTTTAG TAGAGACGAC GGTTTTGCAA TGTGGGCCAG CTTGTCTCG |
| 48401 | AACTCCTGAC CTCAAGTGAT CCTCCAGCCT CGGCCTCTCA AGTGCTGGG |
| 48451 | ATTACAAGTG TGAGCCACTG CACCAGGCCA AAACTTGTA TTTCAATAGT |
| 48501 | CATTGAGGCT GGGTGCAGTG GCTCACGCCT GTAATCCCAG CACTTTGGGA |
| 48551 | GGCTGAGGCC AGTGGATCAT GAGGTCAGGA GATCAAGACC ACCCTGGCTA |
| 48601 | ACACAGTGAA ACCCCATCTC TACTAAAAAT ACACACAAAA ATTAGCCGGG |
| 48651 | CATGGTGGCA AGATGCCTGT AGTCCCAGCT ACTCAGGAGG CTGAGGCAGG |
| 48701 | AGAATGGCGT GAACCTGGGA GGCAGAGCTT GCAGTGAGCG GAGATCGCAC |
| 48751 | CGCTGCACTC CAGCCTGGGC AACAGAGAGC GACTCTGTCT CAAAAAAAA |
| 48801 | AATATATATA TATATATATA TATATTCATT GAGACCGACT CTGACTTAAA |

TABLE 27-continued

Genomic CA125 Amino Terminal Sequence
(SEQ ID NO: 311)

| | | | | |
|---|---|---|---|---|
| 48851 | AGCAGTAATG | AATGGTGTAG | GTTTTGGTAA | ATTACAGGTC | TTGCTTTAAG |
| 48901 | TCCTGGTCCT | CTCTTTTGCT | CACTGTGTGG | CCCCGGAAGA | GCCATGTAAC |
| 48951 | CTCTCCAGGC | TTCAGTGTCC | ATTTTTAGAA | CGGAGTAAGT | GAATAAGCTG |
| 49001 | TGTCCAATCA | TCTCTGGCCA | TATCAGCTTC | ATTTTTTTTT | TCCTCCAGGG |
| 49051 | TCCAAACATC | CCTCCACCCT | CAGAGTCTTT | GCACCTGGTG | TTCTTGTCCT |
| 49101 | TCAAATCTCA | GCTTGGATCA | CCCTTTATAA | AGTAGCATTT | CCCCCGTATA |
| 49151 | CGCATCTTGC | ACACAGCCAA | TCTCTATTCT | ACCTCTATGC | TCACTTCCTT |
| 49201 | CCTGGCAATT | ATTACTACAG | CTGGGCCCTT | GAACAGCATG | AGGGTTCAGG |
| 49251 | GTGCTGACCC | CTATGCATTC | AAAAATCCAC | ATATAACTTT | TTTTTTTTTG |
| 49301 | AGATGGAGTT | TCACACTTGT | TGCCCAGGCT | GGAGTGCAGT | GGCGCCATCT |
| 49351 | TGGCTCACTG | CAAACTCTGC | CTCCTGGGTT | CAAGTGATTC | TCCTGCCTCA |
| 49401 | GCCTCCTGAG | TAGCTGGGAT | TACAGGCATG | TGCCACCATG | CCCAGCTAAT |
| 49451 | TTTGTATTTT | TAGTAGAGAT | GAGGTTTCTC | CATGTTCGCC | AGGCTGCTCT |
| 49501 | TGAACTCCTG | ACTTCAGGTG | ATCCGCCTGC | CTTGGCCTCC | CAAAGTGCTG |
| 49551 | GGATTACAGG | CATGAGCCAT | GATGCCCGGC | CATTTGCTAA | TGGCATCTAG |
| 49601 | TAAGTAGAGG | CCAGAGATGT | TGCAAAACAT | CCAACAATGC | ACAAAGCAGC |
| 49651 | CTCCTATCAA | AACACATTAT | CCAGACCAAA | ATGTCAATAG | GGCTGAGGTT |
| 49701 | GAGCATCTGC | TGTACACAGA | TTCCAAGTTC | TGGTACAAAT | CTCGTAGTTC |
| 49751 | TCTGAGGGCT | CATCTTTCAA | TGCCTAGCAC | ATCAAAGGAG | GCCAATTTCC |
| 49801 | TCTTCCCTTT | CACCTCCTGG | TATGAAATGT | TTCCTCCTCC | ACCTTGATCC |
| 49851 | TGTAAGAGCC | CAGCTGGAGT | TTGCAGACGA | CGGGGAAAGA | AATGGGTGAG |
| 49901 | GGAGGGTCCT | ATGGTTGAGT | CTCCGCAGTG | GGCCCTGGGT | GCCCAGTTCA |
| 49951 | CCCTCCTCCC | CTTCATTTTC | TCCATCATGA | CAACTCAAGG | CAAATTCTCA |
| 50001 | GTTTCCATGG | GCCAGTGGAA | TCCACTGACT | TCATGAAATA | ACCCCACCCT |
| 50051 | GAGCAAATAC | CCCTCAAATA | ATAACTGTTT | ACACAACATC | AGTGGCAACA |
| 50101 | ATGACCCAAG | CAGCAATGCC | ACCACCAGAA | TAGCAACCAT | AACAGCAGCT |
| 50151 | CATTTTCATC | AAAAGGAAAC | TGTAGGGCCA | GGCACAGTGG | CTCACACCTA |
| 50201 | TATTCCCAGC | ATTTTGGGAG | GCTGAGGCAG | GCAGATCACC | TGAGGTCAGG |
| 50251 | AGTTCAAGAC | CAGCCCAGCC | AACATGGTGA | AACCCCATCT | CTACTAAAAA |
| 50301 | TACAAAAACT | AGCCAGGCTT | GGTGGCATGT | GCCTGTAATC | CTAGCTACTC |
| 50351 | GGGAGGCTGA | GGCAGGAGAA | TTGCTTGAAC | CTGGGAGGCA | GAGGTTGCAG |
| 50401 | TGAGCTGAGA | TTGTGCCACT | GCACTCCAGC | CTGGGCGACA | GAGCAAGACT |
| 50451 | CCGTCTGAAA | AAAAAAAAA | AAGGAATTGT | GCCAGGAATT | GTGATGAGAA |
| 50501 | CTTTATATGC | ATTATCTCCT | ATTAATATTA | CCCAAACCTC | CGTGAGTTAC |
| 50551 | TATACTCATT | TCTACAGAGA | GCATTTATGC | ATCCAGGGAG | GAAGTAATTA |
| 50601 | GCCCAGAATT | ACTCAGTTAT | GACACAGGAC | AGTATGAAAA | CTCCAACCGA |
| 50651 | AGATTGGAGA | CTCATGAAAA | CTCCAGGCTC | CTAACTACAA | GACATCACTG |
| 50701 | TGGATCGTCC | AAATAGAGCA | AGCCCAATC | TCAGGACAGG | AATGAGGCAT |
| 50751 | GAATGGCCTC | TATGCTAATG | ATCTAACCTA | ATGCTGAATT | TGTTACTTCC |

TABLE 27-continued

Genomic CA125 Amino Terminal Sequence
(SEQ ID NO: 311)

```
50801  CTTCTGAATC CACTTGGAGA TTTCCTTTAT ATCTGACTTG AAATAGAGGA
50851  TATATACTCC TCTATCCTTG ACATAGGAGA TAATACACAG AAAGTATTTC
50901  ATTGTAGTAT CAAGTACACA TCCTGTTCTG TGTCCATAGG ATTATGACTA
50951  ATTTAGGGCA TGGCTTAACA GTGTGGTACT ATTGAATGAC AGACAGATGT
51001  CTGTTTTGTT GGATGCAGGA CAAGCCATGT AACCTCCCCA GACTTTAGTG
51051  TCCCCTCTGT GGAATGGAAT AAAAATACTA CGTGGGATTG TTCTGATAAT
51101  CAAATGAGAT AATTCAGGAA CAACCCAGAT AAATAACAGG CTGCCCTGG
51151  GTTCTGTCTT TCCTTGTATC TCTCACAGAG CCTCAAAGGA GATGCAATCC
51201  ATGACCTAGA GAAACACTCA GGACAAATTC TCTTTTCCCC AGTTCCTTTC
51251  TTGCTCCAAT GGCAACACCA CCCCTCTCAT CCTGAAGTCT CTTGTTTTTA
51301  CCACCACACC TATTTTGCCA AATTTTCTCC AATATTCCAA ACCATATGAA
51351  ACCTTTCTTT CTTTCTTTTC TTTCCTTCCT TTCCTTCTTT CTTTCTTTTT
51401  TCTCTTCTTT TCTTTTCTTT TTGAGACATG GTCTCACTCT GTTGCACAGG
51451  CTGGAGTGCA ATGGCACGAT CTTTGCTCAC TGCAACCTCC GCCTCCCAGG
51501  TTCAAGAGAT TCTCTTGCCT CAGCCTCCTG AGTAGCTGGG ATTACAGGCG
51551  CCCACCGCCA CGCCACGCTA ATTTTTGTGT TCTTAGTGGA GACGGGGTTT
51601  CGCCATGTTG GCCAGGCTGG TCTTGAACTC CTGACCTCAA GTGATTTGCC
51651  CATCTCGGTC TCCCAAAGTG CTAGGATTAC AGGCGTGAGC CACCAAGCCC
51701  GGCCCCATAT GAACCGTTTC TATCCCTCAT TTCTCTGTAC TTTTACCTAA
51751  AAACACCACT CCCTTCACCC ATCACATTTT TGTCAATTCT ACATCACACA
51801  CACACACACA CACACACACA CACACACAGA GAAAGTAAGT TGGAAAAAAA
51851  TTATACTATC ATGAAATTTT GTGAAAGGAG GTAAGCTGAG AGAGTAAGAA
51901  TCAAACTAAA TTATCTTTAT GGGTAGAAAG CACACTCATC CATACATGTG
51951  TCTTTCCACC CTTGTAATGT ATTTATTATT ATTGTTTGTA TATACTAGAT
52001  TCCCAATAAA TAGGGACAGC TATTATGGTA TTTTTATTTC AGGAATAATA
52051  ATAGTGATGA TTTCCACCAT TATTGTCAAA GGACAAAGCA CAAAATATGT
52101  ACCAAATAAA ATATAGCCAT TATCCTTTAT TCACAAAAGA TCTTGGCCCC
52151  ACCTCTTCTC AATGAAATGT CCATGACTTG TTCAACTTTG CCACTCTGG
52201  GCTGAGAGAT GGAGGTTCCC TTGCGAGCTG AAGTCACACA TCGAAGGTGG
52251  AAGCCCCTCC CCTCCCTCTG GCTGGCTGAG GGATAGCCCA GATGGGCTCA
52301  TCATGAAAGT TTCCCATTAT TTCCATTTCT GGATCTACCA TCTTCCCCTC
52351  CCCTACCTCT CACCCATCAT AATTGTCCTT CTTTACTCTT TCCTCCCTAT
```

Exon 8

```
52401  CTGCAGGTTA TAACCGTCGG TACTGGACCC CTGCCACCAG CAGTGAGTAT
52451  TCAAACCTGT GATATTCCAA TGCCCTTGGG ACCCTTCCTC CCCAAGGTGC
52501  ATTCCTCAGA AGAGAAACTG ATCATTCTCC CTCCCTACGT GCCCAGCCAC
52551  AGCCTCGAGA CAGCCCCTAA CCCGTCAAGG TCTTGGTGTG AGTCAAGATA
52601  GAAGTCCAAA TTCAATGAG CAGTTCCTGT CCCATATTCC TTTAGGAAGA
```

TABLE 27-continued

Genomic CA125 Amino Terminal Sequence
(SEQ ID NO: 311)

Exon 9

```
52651  CACCCAATCA TTTCTCCATG TTCTTTTTTT CTCAGCTCCA GTGACTTCTA

52701  CATTCTCCCC AGGGATTTCC ACATCCTCCA TCCCCAGCTC CACAGGTAGG

52751  AAGCTCCTCT CTGGCATCTA TGAAATTTAA CACTGCATGG TCTGTTCCCT

52801  GCTGACCACC CAGACTCAGC CTGTTCCACT CGCCCTCTCA CTCTCTCTCT

52851  CTCTCTTTTT TTTTTTTTTT TTTTTTTTTT TTTACGGAGT CTTGCTCTGT

52901  CACCCAGGCT GGAGTGGAAT GGTGTGATCT CGGCTCACTG CAACCTTCGC

52951  CTCCCAGGTT CACGTGATTC TCCTGCCTCA GCCTCCGGAG TAGCTGGGAT

53001  TACAGGTGCA CACCACCATG CCTGGCTAAT TTTTTGTATT TTTAGTAGAG

53051  ACGGGGTTTC ACCATGTTGG CCAGGCTGGT CTTGAACTCC TGACCTCAAG

53101  TGATCTACCC ACCTTGGCCT CCCAAAGTGC TGGGATTATA GGCATGAGCC

53151  ACCACGCCAG GCCCACTCTC TAAATTTTGA CCACCCTGCC TTGAGTGGTC

53201  TTCTAGCACC CTAACCTCTG TCTAACCTCG AGAGCTTTGC ACTAGCGATT

53251  CCTGGGGACC AGCTATGGTT GGTATCTTCT CAACTTTCTA ATTTTTTTAA

53301  AATTATTATT ATTATTATTA TTATTTTAAA TGGAGTCTCG CTCTGTCACC

53351  CAGGCTGGAG TGCAGTGGCA CCATCTCGGC TCATTGCAAC CTCTACCTCC

53401  CGGGTTCATG CAATTTTCCT GCCTCAGCCA GAAATTTCT CAGTGGTCGA

53451  GATTGTGCCA CTGCACTCCA GCCTGGGCAA TGGAGCTAGG CTCCATCTCA

53501  AAAAAAAAAA AAAAAGACG GAGGTCGGGC ATTCCTAACC CTTAACCCTG

53551  CCTTGTGATT CTGGAGTTAT GAGATAGAAC CTGGTGTCCC GTAATTAAAA

53601  TTCCGCCTTC AGGCCTTATG TTTTGTGAGT CACAACACTG CAAACTTTTT

53651  ACATGCTGTA GACAGGATGT TCACTCTCCA CTTCCTCACT GCTCTGCTCT

53701  AATCAATTCA ACCATTTATG TGACATGCCT AACCCCTCTG GCTTGTACG

53751  TATGTAACAT GTATTACAAA GCAAGTCATT CCATGATCAA TGCTGTCACT

53801  TTTTCTAGGT GCTTTCAAAA TTTGTTCTTC ATCATTGATT TTCAGTAGTT

53851  TGATTACGAT GTGTCTGGGC ATGGTTTTCT TTGAGTTTAT CCTGCTTAAA

53901  GTGTTCTCAG CTTCTTGAGT CTCAAAGTGT TTATTTTCTG CTCTGATTCT

53951  TTCTCCCCTT CGGACCTCCA ATGAAATGAT GTTGCCCGAA GAGACCCTGA

54001  GGTTCTGTTC ATTTTGTTAT TTATCAATCT TTTTTCCTCT CCGAATTTCA

54051  GGTTTAATAA TTTTTTTTTT TTTTTTGAGA CGGAGTCTCG CTCTGTCGCC

54101  CAGGCTGGAG TGCAGTGGCG CGATCTCGGC TCACCGCAAG CTCCGCCCCC

54151  TGGGTTCACG CCATTCTCCT GCCTCAGCCT CCGGAGTAGC TGGGATTACA

54201  GGCACCCGCC ACCATGCCCG GCTAATTTTT TGTATTTTTT AGTAGAGACG

54251  GGGTTTCACC GTATTAGCCA GGATGGTCTC AATCTCCTGA CCTCGTGATC

54301  CGCCCGCCTC AGCCTCCTAA AGAGCTGGGA TTACAGGCGT GAGCCACTGC

54351  GCCCGGCCCA GGTTTAATAA TTTTTATAGA ATATTTTCAC AATCACCAAG

54401  CCTTTTCTCT ACCAGCTCCA TTCTGCCCAT CCATTGAATT CTTTTTATCT

54451  CAGTTACTTT ATGTTTCAGT TCGAAAGTTT CTACTTGGTT AGATAGATAG

54501  ATGTTATATC ATATATTATA TGTTATATAA AAATATATTT ATGGTTATAC
```

TABLE 27-continued

Genomic CA125 Amino Terminal Sequence
(SEQ ID NO: 311)

```
54551  ATATAACATA TATGTTATAT ATAGTTATTT ATATAGCCAT AACTATATAT
54601  AGCCATATAT ATAGTTATAT ATAACCATAT ATATAGTTAC CATATAGTAA
54651  CCACATATAT AAAACATATA TATATAGTGT CTCTCTATAT ATAGTTATAT
54701  ATATAGTTTC TATATCTGTA ACTATATATA GTTATATATG TATGTTTCTC
54751  TGTATATAAA TATATATATT TCTATATATA TAGTTATACA CATTATATAT
54801  ATAACTGGGA GATGTTGGTA AAGGATGGCG TGAGGAAACC TGGAGCAGTC
54851  ATGGTAATCC TCGCTCTGCT CCGAACTCCT CAAGAGCAGG AGAAGGGTCC
54901  TCCTCATTCT CCAGCCATGT TGACTTTGAG CAATTTACTC ATCCTCTCAG
54951  TACCTCAGTT TCCTCACCTG CCAATTGAGG ATAATAATAT TTCATAAATT
55001  GTTTGCAAAT GTTATATGCA ACTCTACGTA AGAACACCTA GCACAGGGGC
55051  TACCAGGGAA TTTGGTTTAA CAAATATTTA TCAGGCACCT ATTCTGGGCT
55101  GGGCAGGGGG GATAAGATGT TGACTAAGTC AAATGCAGTC CCTCCCCTCA
55151  CCAAGTTTAC AGTGTATTGG GCAAGACTGA AATGGAACAA GCAATTACAA
55201  TTGACAATAA AAGACAACCA AGTTATTGAG CACTTACTAT ATGGCATGCC
55251  ATATGCTATG TATTTTTTTT ATTTTTAACT TTTCATTTTG AAATAAATAA
55301  TAAATATAAA GTAAATAATA ATATAAATAA ATAATAAATA ACTTTTCATT
55351  TTGAAATAAA TAATAAATAA ATTCAGGAGA TGTTGCGAAA ATAGTGTAGC
55401  ATTCCCCTGT ATCCTTCACC CAGTTTCTCC CCAATGGCTA CATCTTACAT
55451  AACTCTAATA CAATATCAAA AGCAGGAAAC TGACATTGTT AAAATCCATT
55501  TTACTGGTTT TACACGCGTG TGTGCATATG TGAGCTTGTG TATGTGCGTG
55551  TGTGTGCAGG CATGTGTGTG CATGCACGCC TGTGTGTGCA TATGTGCATG
55601  TGTGCATGCG TGTGTGCATG TGTGCATGTG TGTGTGCATG CGTGCGTGCG
55651  TGCGTGCATC TGTGTGCATG TATGCACATG TGTGTGTGTC TGTGCACGTG
55701  TGTGCATGCA TGTGTGTGTG CGTGTGTGTT GGTAGCCCTA TGCAATTTTT
55751  ATCACATGGG CATAGCCCTA TAATCACCAC CACCATCAAG ATTCAGAACT
55801  GTTCCATTCC CCCAAAGATT CCCCTCATGC TAGCCTTCGT AATCATGCCC
55851  ACTGAGCCCA ACACTATTGC ATAGAATAGC TATTCTACTC TCCATCTCCA
55901  TCTCTGTCTC TACAATTTTC TTTTGAAGAT GTTATATAAA TGGAAATGTA
55951  CAACATGTCA CCTTTGAAAT TGGCTTCTTT TCCACTCAGT GTAATGCCCT
56001  GGAGATGTGC TCTTTTTAAC AGTCATGTAA CCTTCCTAAT TTCCCTCCAA
56051  AATATCATTA TGCCCCTCGC CGCCTTTTTT TTTTTTTTT TTTTTTGAGA
56101  CAGAGTCTCG CTCTGTTGCC CAGGCTGGAG TGCAGTGGTA TAATCTCAGC
56151  TCACTGCAGC CTCCGTCTCC CGGGTTCAAG GGATTCCCCT GCCTCAGCCT
56201  CCCAAGTAGC CAGGATTACA AGTGCATGCC ACCACGCCTG GCTAATTTTT
56251  GTATTTTTAG TCGAGACGGG GTTTCATTGT GTTGGCCAGG CTGGTCTCGA
56301  ATTCCTGACC TCAAGTGATC TGCCCGCCTT GGCCTCCCAA AGTGCTGGGA
56351  TTACAGGTGT GAGCCACCGC GCCCGACCCA TATTGCCCAT TGTATTACAG
56401  CGGAAGAAAC TGAGGTATGG ACAGGTAACA TGTCCATGGT CACTTGGCTG
```

TABLE 27-continued

Genomic CA125 Amino Terminal Sequence
(SEQ ID NO: 311)

```
56451  GTGAGGGGCA GAGAGGAGAT TTGAAACCAA ATCTGACTCA CTAGTGTGGC

56501  CGTAACCATG GTAACTATGT CTCTCTACCA TGTGGTCTCC TCTTTATTAA

56551  AGGAAGGGCA AGTTCTGGGA GTTTTGGGAG TTTTGGGCTT GAGTGGGGAA

56601  GGGTAGCCAA GTAAAGCAGG TGAGAGAAGG TCTGCTTTAA GGACTGCTGT

56651  TTGATTTTTA TTGTTGTTGT TCAGTGTTCA ATGGGATTGA GTTGACTCTT

56701  TTTTCCCTTC TTGTTCCCCA AAGCATGAGA CTGTTCCGGT CCTTTCCCT

56751  TTTAACTTCT CAGCTAGAGT TTGTTAGGGC GGGTATGGGC ACCTGGCAGA

56801  GTCTGAGACC TCAGCTTCCA GTAGGCACAC GTTCTGACCC AATACACCTA

56851  CCCTGGTCCC CTAACCTGCT TCTGGTCCCC TAACCTGCTT CTGGGCCCAG

56901  GTAATGCATT TTAGGAACAT CCCACTTTTC TCCTTACCTG GCTTTCCATT

56951  ATCCGTCCAA ACTAAAGCAC CCACCTGTCT GCTTCAGACT CTTGCTTCAA

57001  GCACTCCGTC TGGGTCCTCA GAAATTGACT TACAGTCAGT TCAGATCTGA

57051  CTCAGGCGTG GCCTTCTTTT CTCCTTCCTT GC
```

TABLE 28

Genomic Repeats
(SEQ ID NO: 312)

Exon R1
```
   1  AGCAGCCACA GTCCCATTCA TGGTGCCATT CACCCTCAAC TTCACCATCA

51  CCAACCTGCA GTACGAGGAG GACATGCGGC ACCCTGGTTC CAGGAAGTTC

101  AACGCCACAG AGAGAGAACT GCAGGGTCTG GTGAGAGCCC CGCCCACCGT

151  ACTCCTCCCT CGCCCACTTA GACAAACCAG CCCACCTCAC ACTGCCTCGC

201  CCACTGATGC CAGCCACGCC CACCTCATCC AACCCCAGAC ACCTTTCCCT

251  GCCCCACCCA CTGATTTTAG CCAAGCCCAC CTCACCCCAC CAGCCTACT

301  GATGCCAGCC ACGCCCACCT TTCCCTGCCC CGCCCACTGA TTTCAGCCAC

351  GCCCACCTCA CCCTGGTCCA CCCCTCCAAT GCCCCACTCT TCCTGGCTTC
```

Exon R2
```
 401  CCGCAGCTGT TGTTTCTCAC CTCCCCTCTC CTTCCTTGCA GCTCAAACCC

451  TTGTTCAGGA ATAGCAGTCT GGAATACCTC TATTCAGGCT GCAGACTAGC

501  CTCACTCAGG TGAGACGCTC CTTAAGAAAA ACACAGCCCA ACAGGTGAAT

551  ATGACCCTAG TCTCTGGGCT CCCTGACTCT GTTCATACTT GGAACAACTA

601  TTGCCCATGG ATACTAAGCA TCACCACCAG CAGCAGCAGA TAACTATTCC

651  TAAGACCCAA GGCACTGCAT TATGTACTTT ATATTTAATG CCTCATCAGT

701  GCTTGCAACA GCCTCATGAA GCAGGAGCAG AAGGGGAAAC TGAGGCCCAG

751  ATTAAGTGGC TTGTGCCAGG ACACACAAAG CAACTGCAGC ACTTCAGGTT

801  CTATATCCAA ACTCCTATCC CTTAGGTGGC ACTTCCTCCT CTGCCCCCAT

851  TATGAACTTG CAGCATGTGG AAAACCCCAA TCTGACTTCC CTCTAAGGGA

901  ACTTGCCCAG AGAATCTAAG AGGGGAGGAA AGGAAGGCGT TCAGCCCTTA

951  CAGGCAGGAG GTCAGCTCCT GAGTGGCTCA GATGCAGCCA CAGAGGGCCT

1001  GGCCGGTCTG AGGGTGACTG AGAGGCACCG AGGGCACTGT CCCTGAGTGC
```

TABLE 28-continued

Genomic Repeats
(SEQ ID NO: 312)

```
1051  TGGAAAGGGC AGGTCTTTTA GGGTAGACAG CGGTTGATAT CATTTCCTGC
1101  CTGGCATTCT CACCTTCCAC ACCTCTCTCA CAGAATCTCC AAGTGTGGCT
1151  CTCCCAAGAG AGAGTGTCAG TCATCTACCT CCAGCTTCCT TTCCTTCCCA
1201  GGGGGAAGAG GGGACAGGGG GGCCCTAGTG GCTAAGAGCA TTGGTGAACT
1251  CAGGCAGACC TCAGTTCTGA ACCAACCCAG CTCTGCCATT TACTATCTGT
1301  GACTCTGAGC AAGTGCCTGA AGCCTTCTGT GCCCTATTTC CTGACATATT
1351  ATATATATAA AATACATATA TTATATATAG ACATATTTTA TATACATATT
1401  GAGGCATATT TTATAAACAT GTTTATAGAC ACATTTTTAT ATGCATATGT
1451  TATATACGTA TATAACATAT GTTATATATA ATGTATATAT TATACATATT
1501  GTTATATTGT ATACATGTTA TATATGTTAT AGCATATATA GTACAAGTTA
1551  TATATAACAC ATACATTATG TTACATATAA TGTATATGTT ATATATGATA
1601  TATTATATAT AATTATATAT TATATAAAAC TGTTATATAT AATTATATAT
1651  AATATATAGT TGTTATATAT AATTATATAA TTGTTATATA TTATATACAA
1701  CATATAACAT ACATTATATA TTGTTATATA TAATATAATA TATACATATA
1751  TAACATATGT ATAACTTTTA TGTTATACAT AATGTATATA ACATATATGT
1801  GTATGTGTGA TGTACATAAC ATATCTGACA TTAACATATA ACATATGATA
1851  TAACAATATT ATATGTTATA ACATAATATA TGTTATAATA TAACAATATT
1901  ATATGTTATA ACTTATACTG TCATATGTAA CATATACATA ATATTTTATA
1951  AATCAGTTTA ATATACATTA TGTTACATAT AATGTATGTT ATATATGATA
2001  TATTATATAT AATTATATTA TACATAATTG TTATATATAA TGCATACATT
2051  GTATTTGTTA CGTATTATAT GCAACATATG GGGATCCTCT AGAGTCGGAC
2101  CAGCGGCAGC AGCTGCCTGC CTTTTNNNNN NNNNNNNNNN NNNNNNNNNN
2151  NNNNNNNNNN NNNNNNNNNN NNNNNNNNNN NNNNNNNNNN NNNNNNNNNN
2201  NNNNNNNNNN NNNNNNNNNN NNNNNNNNNN NNNNNNNNNN NNNNNNNNNN
2251  ATATACATAC ATAACATATG TATAACTTAT ATGTTATATA TAAGTATATA
2301  ACATATATGT GTATGTGATG TATATAACAT ATCTGACATT AACATATAAC
2351  ATATGTTATA ATATGACATA TTATATATAT TACATATAAC GTATATCATG
2401  TATAATATAA TGTGTATATA TAATATATTA AAGTATATAA GTATAAATAC
2451  ATGTAATATT TAAATATATA TTATATATAG TATACATGTG GATACATACA
2501  ACTTCTACAT ATACCTAGTA TATATTCTAT ATATAAACAG TCCATGAATT
2551  ACAATGATTC AACTTATGAT TTTTCAAACT TTGTGATAAT GCCATAGCAA
2601  TATGCATTCA GTAGAAAGCA TACCTTCAAC ACCCATGCAA CCATTCTGTC
2651  ATTCACTTTC AGTACAATAT TCAATAAATT ATATGAGATA TTCAACAGTT
2701  TATTATAAAA TAGGCTTTGT GTTAGGTGAT TTTGCCCACA TGTAGGCTAA
2751  TGTAAGGGTT CAGAGCATGT TTAAGGTAGG ATAGGCTAAC CTATCATGTT
2801  CTGTAGGTTA GGTATAGTCG ATTTTTATTT TTATTTTTAT TTTTGAGACA
2851  GAGTCTTGCT CTGTCACCCA GACTGGAATG CACTGGTGCG ATCATAGCTC
2901  ACTGCAGCCT TGAACTCCTG GGCTCAAGTG ATCCTCCTAC CTCAGCCTCC
```

TABLE 28-continued

Genomic Repeats
(SEQ ID NO: 312)

```
2951 TGAGTAGCTG GGACTACAGG TGTGTGCCAC CACACCTGGC TATTTTTTTT

3001 TTAATTTTTT TTTTTTTGTG GAGAGGAGGG TCTTGCCATG TTGCCCAGGT

3051 GGCCTTGAAC TCCTGGGCTC AAGGAATCCT CCCACCTTGG CCTCCCAAAA

3101 TCCTGGGATT ACAGGTGTGA GCCATCACGC CCGGCTACAG GGCATTTTTG

3151 ACTTATGACA TTTTCAGTTC ACAATGGATT TGTCAGGGCT GGGCATGATG

3201 GCTCACACCT GTCATCCCAG CACTTTGGGA GGCTGAGGCA GGTGGATCAC

3251 TTGAGGCCAG GAGTTTGAGA CCAGGCTGTC CAAATGGCAA AATCTTGTCT

3301 CTACTAAAAA TACAAAAATT AGCCAGGCGT GGTGTGACAA CTGTAGTTCC

3351 AGCTACTCGG GAGACTGAAG CGTGAGAATC ACTTGAACTT AGGAGATGGA

3401 AGTTACAGTG AGTCAAGATC ACACCACCGC ACTCCAGCCT GGATGACAGA

3451 GCAAGACTCT TGTCTCCAAA AAACAAAAAA CAGGCTGGGT GCATGGCTCA

3501 TGCCTGTAAT CCCAGCAGTT TGGGAAGCTG AGGCAGGTTT ATCACCTGAG

3551 GTCAGTAGTT CACGATCAGC TTGGCAAACA TGGAGAAAAC CCATCTCTAC

3601 TAAAAATACA AAAATTAGCT GGATGTGGTG GTGGGTACCT GTAGTCCCAG

3651 CTACTCGGGA GGCTGAGGCA GGAGAATGGA TTGAACCTGG GAGGCAGAGG

3701 TTGCAGTGAG CCAAGATCAC ACCATTGAAC TCCAGCCTGG GCAACAGAGT

3751 GAGACTCCAT CTCCAAAAAC AAAAGAAAGC AAAAACAAAA AATAAAATA

3801 AAAAACCTGT GTTTATCAGG ACATAATACC ATCATGAGTC AAGAAGCATC

3851 TAAATGTACA TGGTAGTTAT ATAAAAATAG TTATATAGTT ATATACAATA

3901 GTTATATATA AACCAGTTTA ATATATGTTA AGTAGAGGTA TATGGTAGTT

3951 ATATAAAAAA TAGTTATATA ATAGTTATAG AGTTATATAA TTATATAAAA

4001 TAGTTATATA TAAACCAGTT TAATATATGT TAGGTAGAGG TATAATAATA

4051 TATATTGTAT ATACTATATA ATATAGTAAT GTATAAAATG CAAAACGATA

4101 TCATATATTT CTATATTAAG TTTATATTTA CAGATCTACA TTTTATATAT

4151 TTTATGTTAT ATACAATTGT GTTATACATA ATATAATTAG TATAGTACTG

4201 ACTTGGGGAA TTGAGCAGTA CCAACCCATA GGGATGTTTG AGGATGAAAA

4251 TATGTGATTA TGAATACAAA ATGCTGGGCC TGCTGCATAG GAAGTATTTA

4301 ATAAATGGTA GTTGTTACTA TAAAGTCGTT CCTACTATAG AGCTACTCAC

4351 AACCTGGGAC ATAGGGAAAG AGCCCGTTTC CCTCTAATCA CTCAATAGTG

4401 GGTGGCTAGG TAGGTGAGTC CACATCCTGT GGCCGGGAAC AGGTGCTGAG

4451 ACATGAAGAC CTTCTGACTG CATGTTGGAC CAGCCACAGT TTCAGACGGA

4501 CCAGCCAAAA AGGGCATTTT CCCCAAGCCA TTTAGCTCCC TTGAGTCTCA

4551 TAACAAATCT CCTAGACCCT GCTGGTCCAT AGGATCTAGA GAGGATGACT

4601 TGAACCTTCT GATCCCACCA TTTGAAAACG CCATGCCATG GGCACCAGTA

4651 GGAGGGCCAC TGCTACGTGC ACCAGTACAA GGGCCACTGC CATGGATTAC

4701 AGATTAACCC TAAGTATAGC TGTCGCACAC CTAGTACTTC AGGAGGCTTA

4751 TTCGGGGCCA TGCAGATCCC TGGCATTATT ATCCTAGGAT CCTACACCAA

4801 GCAAAGCAGG AGCTGCCCCT CCTCATAAAC CCATAAGCCC TCCTCTTGAG

4851 CAAAGCAGCT GGGAAGGCCA GAAGTTATTC AAGCTCCCCT CTGCCCCGGT
```

TABLE 28-continued

Genomic Repeats
(SEQ ID NO: 312)

```
4901  TCCAAAGACA GACAGCTCAA GCCTACATGC AGCAAACCCT ATAAAAGTGT

4951  CACCTCTTGG CATTTCTGCC ATGGTAATGC TTTCTGCTTC CACTAATAAT

5001  CCTAGTAATT TGTTTATGGT GGGCATCTCT CTGATGAGAA CCACATTCTT

5051  TTTTTTTTTT TTTTTTTTTT TTGAGATAGA GTCTCACTCT GTTGCCCAGA

5101  CTGGAGTGCA GTGGCGCGAT CTCGGCTCAC TGTAACCTTT GGCTCCTAGG

5151  TTCAAGCAAT TCTCCTGCCT CAGCCTCCCA AGTAGCTGGG ACTGCAGGCA

5201  CGTACCACCA TGCCCAGCTA ATTTTTGTAT TTTTAGTTGA GACGGGGTTT

5251  CACCATGTTA GCCAGGATGG TCTCAATCTC TTGACCTCAT GATCCACCTG

5301  CCTTGGCCTC CCAAAGTGTT GGGATTACAG GCATGAGCCA CCATGCCTAG

5351  CCTGAGAGCC ACATTCTTGT TAACCACAAT TTTCTCAGAG TCTGCATTAG

5401  GGGTTGACAA AGAGTGGAAA GGAAGGACAA AAGGATGGAG AGGTGGATGG
```

Exon R3
```
5451  ACTAAGCATA TGTAGGTTCT TACCCAGGCC AGAGAAGGAT AGCTCAGCCA

5501  CGGCAGTGGA TGCCATCTGC ACACATCGCC CTGACCCTGA AGACCTCGGA

5551  CTGGACAGAG AGCGACTGTA CTGGGAGCTG AGCAATCTGA CAAATGGCAT

5601  CCAGGAGCTG GGCCCCTACA CCCTGGACCG GAACAGTCTC TATGTCAATG

5651  GTGAGCAGCT GTGATGTGGT TGGAGGCTCT TCCTCCTTGC TGAGCAGCCT

5701  GTAATCACTG GCTTGAGGTC ACACTCACTG TCAGGCAATT GAAAATTTGG

5751  TCCTGTGCTC TACATGGGAT GACTAATTTC CGGACTTCAT GGTATCTTTT

5801  TTTTTTTTTT TTTTTTTTTG AGATGGAGTC TCGCTCTGTC ACCAGGCTGA

5851  GGTGCAGTGG CATGATCTCA GCTCACTGCA ACCTCCGCCT CCCGGATTCA

5901  AGCAATTCTC CTGCCTCAGC CTCCTGAGTA GCTGGGACTA CAGGTGCATG

5951  CCACCACACC CAGCTAATTT TTGTATTTTT AGTAGAGACA GGGTTTCACC

6001  ATGTTGGTCA GGATGGTCTC AATCTCTTGA CCTTCTACTC CACCTTGCCT

6051  TGGCCTCCCA AAGTACTGGG ATTACAGGCT TGAGCCACCA CACCTGGCCA

6101  GGACTTCATG GTTTCTTCAT CATCATGGAA TGAATTCCAT CAGGGCATTC

6151  TTCCCTGATG TGAGGGCACT GATAGGAAAT CTTTAATGGT CCCTGCTGCA

6201  TGAAACTGCT TCCATTGCAC CAGGGTAGCC CTGACCCCTA TTTGGTCCCC

6251  CACATCTCCT TGTAACTTAC CCACACTCCT CCCTCCTTCT CTGTGCAGGT
```

Exon R4
```
6301  TTCACCCATC GAAGCTCTAT GCCCACCACC AGCAGTGAGT ATTCAACTCA

6351  TGTCCACATG CCCATGATCC TACACCAAGC AAAGCAGGAG CTGCCCCTCC

6401  TCATAAACCC ATAAGTCCTC CTCTTGAGCA AGTAGCTGG GAAGGCAGAA

6451  GTTATTCAAG CTCCCCTCTG CCCCAGTTTC AAAGACAGAC TCAGCTCAAG

6501  CCCACATGCA GCAAACCCTA TAAAGTCTC ACCTCTTGGC ATTTCTGCCA

6551  TGGTAATGCT TTCTGCTCTC ACTAATGAGG ACTTCTCCTC AGCTCCTGGG
```

Exon R5
```
6601  ACCTCCACAG TGGATGTGGG AACCTCAGGG ACTCCATCCT CCAGCCCCAG

6651  CCCCACGAGT AAGTACCAGT CAATGGCATC TCTATTAGAG CATGCTATCT

6701  CTGTCATTTT TACTCAGATG AAGATGGAAA ATCATAGCAA ATCTACTGAT
```

TABLE 28-continued

Genomic Repeats
(SEQ ID NO: 312)

```
6751  AGTGAGTGGA CCAACGAAAT TGTTGGCCA CCTAGTGTGT ACCAGATCCT

6801  AGAGATACAG GAGGGAAAAC AAAACCAATA CAAAATTTCT GCTCTCAGTG

6851  AGCTTGTATT CTTGTCATGA TGATGATGTT GGTGGTGGTG CTGTTGATGA

6901  CGATGATGAT GATGATGATG ATGATGATGC TGGTGATACT GTTGATGGTG

6951  ATAGTGATGT TGATGACAAT GATGATGATG ATGATGTTGA AGAAAATGAT

7001  GCTGGTGATG GTGGTGGGGG TTATTATGGT AATAATGATA TGTTGAGTGT

7051  GACGATGATG GTGGTGGTGT TGATGATGAT GATGATTATT ATGCTAGTGA

7101  CATTGATGAT GGTAATGGTG ATATCAACGA CAGTGACAAT GATGGTGATG

7151  AGGATGATGT CGGTGATGGT GGTGGGGTTA TGATGGTAAT GATATGTTGA

7201  ATGTGATGAT GGTGATGATG ATATTTGTGG TTCATGATGG GGATTGTCAT

7251  GGTGGTGGTG GTGGTACTTG TGATGACAAT AATGATAATA ATGATGACAA

7301  TGATAGTGAT GATGGTGATG GTGATAATAA AGATAACAGA TATCACCTTA

7351  CAATATTGAG CACTAAATAT GTACCAAGAG CTATGCTCAG TATCTAACTA

7401  CTATTATATA ATCTACTTTA GAAATGAAT TGTATCATAG ATAAGAAAGG

7451  CGTGGAAAAT ATTTATTATG TCACTCAATT TAATTGCTGC ATATGGTTAT

7501  TACAAAGTGC TATTCTCTCT ACTTTGAACA TAATGTTTAT TCACACTCC
```

Exon R1
```
7551  CACTATAGCT GCTGGCCCTC TCCTGATGCC GTTCACCCTC AACTTCACCA

7601  TCACCAACCT GCAGTACGAG GAGGACATGC GTCGCACTGG CTCCAGGAAG

7651  TTCAACACCA TGGAGAGTGT CCTGCAGGGT CTGGTTAGTG TCCTGCCCTC

7701  CACACTCTGC CCTGCTCATG ATACCCAGTC CCTCTTACAT CATCCATGCC

7751  AGGGCAATGG AAGAATATCA AACCCAACTC ACTTTTGCCC CAAGAGATGC

7801  AAGCCTCAGC CAGGAGCGGT GGCTCACGCC TGTAATACCA GCATTTGGGA

7851  GGCCAAGGCG GGTGGATCAC CTGAGGTCAG GAGTTTGTGA CCAGCCTGGC

7901  CAACATAGTG AAACCTCATC CCTACTAAAA TACAAAAATT AGCCAAGCAT

7951  GGTGGTGCAT GCCTGTAATC CCAGCTACTT GGGAGGGTGA GGCAAGAGAA

8001  TCACTTGAAT CAAGGAGGCA GAGGTTGCAG TGAGTCAAGA TCATGCCACT

8051  TTACTCCAGC CTAGGCAAAA AAGCGAAACT CCATCTCACA AAAAAAGAA

8101  AAAAAGAGAG AGATGCAAGC CTCCCCCACC AAGGCCAGCC CTGCCCACCT

8151  CACTTCTGCC TGGCTCTTAC ATAAAACTTA GCCCTCCTAC TCACTGCCCT
```

Exon R2
```
8201  CTCCCTCCTC CACAGCTCAA GCCCTTGTTC AAGAACACCA GTGTTGGCCC

8251  TCTGTACTCT GGCTGCAGAT TGACCTTGCT CAGGTGAGAA CTTAGAATTT

8301  CCAGCCTGGC TGCCCCACTT GTACTCACTC CAAAAGACTT TGCACTGCTT

8351  CCTTGCTGCA CTTCCTAGGG ATATCCTCAC CAAAGGTGGA ATTCAGGAGT

8401  CACAGGCTTC AGGATCAGTG TGTTTCCTGA CAGTAACACC CCTACACTCC

8451  ACCTCAACAG AGAGAATCTG CATGGCCCAT CATCAGGATT GAGCCTCTCC

8501  CTTTATCATC CCTCTGAATT CCCTCCATTC CCTGTGCCTC CCTTTCCTTT

8551  ACATGTTAAA TTCTGTCCCC AGGATTTCTT TCAGGACAAT CATGCCTTAT
```

TABLE 28-continued

Genomic Repeats
(SEQ ID NO: 312)

```
     8601 CCACGTGATT TCATCCTCAT TTCGAGCTCT TCACTGGGCT CAAGTCCGGC

8651 TCCCCGTCCC GTCCATGAAA GTGTCAGTTT CATCTTGTCA CTGTATCCGT

8701 GACTCCACTC ACAGTCCTCA GCAAGCCAAT AGTCCATGCA CTAAGAGTCG

8751 ATGTGGCTTC TCACCTCTTT CCCAGGTTTC TCATTTCTCT GGTCCTTGCT

8801 GTCCTTCCCT CAGCAATCGC AAGACCCTTC CTAGATAAAC TTTTCATTGT
Exon R3
     8851 GATTTTTCCC ACTGACCCTC CCCAGGCCCG AGAAAGATGG GGCAGCCACT

8901 GGAGTGGATG CCATCTGCAC CCACCGCCTT GACCCCAAAA GCCCTGGACT

8951 CAACAGGGAG CAGCTGTACT GGGAGCTAAG CAAACTGACC AATGACATTG

9001 AAGAGCTGGG CCCCTACACC CTGGACAGGA ACAGTCTCTA TGTCAATGGT

9051 GAGTGGCTGT GATGTGGTTG AAATCTCTTC CCCCTTGCTG GGCAGCCTCT

9101 AATCTCTAAC TAGAGATCAC ACTCCCTGCC TGGCCTTTGA AAATTCTGTC

9151 ATGTGCTCTA CATGGGATGA CTAAGGTCTG GACTTCATGG TTTCCTTACC

9201 ATCATGGACT GTGTTCCCTC AGGGCATTCT TTCCTGATGT GAGGATGCTG

9251 ATAGAAAATC TTCAATTGTC CCTGTACCAT GAAACTCGGT TCATTGCACC

9301 AGGGTAGCAT TGACCTCCAT TTGGTCCCCC ACCTCTCCTT GTCTCTTACC
Exon R4
     9351 CACTCTCCTC CCTCCTTCTC TATGCAGGTT TCACCCATCA GAGCTCTGTG

9401 TCCACCACCA GCAGTGAGTA TTCAACTCAT ATCCACATGC CTCGGTTCCT

9451 ACACCAAGAG GAGCAGGAGC TGGCCCCTCC TCATAAACCC ATTAAGTCCT

9501 CTTCATAAGC AAAGGATTTA GGAGGGCAGA AGTTATTTAA GTGTCCCTCT

9551 GCCCAGCTCA AGAGACCGAC CCAGCTCAAG CTACACATGC AACAAACCCC

9601 ATAAATAGTC TCCCCTCTTG CCATTTCTGC CAAGAGAGTG CTTTATGCTT
Exon R5
     9651 TCACTGATGA GAACTTTTCC TCAGCTCCTG GGACCTCCAC AGTGGATCTC

9701 AGAACCTCAG GGACTCCATC CTCCCTCTCC AGCCCCACAA GTAAGTATCA

9751 GTCAATGACA TCTCTATGAG AGCATACCTG ATTAGTGTAA ACATCTCTGT

9801 CATTTTCACT CAAATAAAGA TGGAAAATCA TAGTAAATCT AGTGATACTG

9851 AGTGGACAAA TTTGTTTGTT TGTTTTTTCT CATCCTTTTC ACTTTTTTTA

9901 TTATACTTTA AGTTTTAGGG TACATGTGCA CAATGTGCAG TTTAGTTACA

9951 CATGTATACA TGTGCCATGC TGGTGTGCTG CACCCATTTG CTCGTCATTT

10001 AGCATTAAGT ATATGTCCTA TGCGATCCAA GCCCACGCGC CGCACCACGT

10051 GCAACAGTTT CACAGATTGG ATGGTCCGAT ANNNNNNNNN NNNNNNNNNN

10101 NNNNNNNNNN NNNNNNNNNN NNNNNNNNNN NNNNNNNNNN NNNNNNNNNN

10151 NNNNNNNNNN NNNNNNNNNN NNNNNNNNNN NNNNNNNNNN NNNNNNNNNN
Exon R1
    10201 CTTCACCATC ACCAACCTGC AGTATGAGGA GGACATGCAT CGCCCTGGAT

10251 CTAGGAAGTT CAACACCACA GAGAGGGTCC TGCAGGGTCT GGTTAGCACC

10301 CTGCCCTCTT CACTCTCCCC CGCCCTGGAT GCCGAGCCCC TCATACAACA

10351 TTCATGCCAG GGCAATGGAA GAATATCGCA CCAACCTTGC CCTCATCCCC
```

TABLE 28-continued

Genomic Repeats
(SEQ ID NO: 312)

```
10401 AGAGATGCAA GCCTCACCCA CTGAGGCCAG CCACTCTCAT GGGTGTCTGC

10451 CCCACCCACC TCACTTTTGT CCCCACACAG GGACCTTAGC CCTCCTACTT
```

Exon R2
```
10501 ACCTCTCTCT CCCTCCCCCA CAGCTTAGTC CCATATTCAA GAACACCAGT

10551 GTTGGCCCTC TGTACTCTGG CTGCAGACTG ACCTCTCTCA GGTGAGACCT

10601 TAGAAGATCC AGCCTGGCTG CCCCAGTTGT TCCCACTCCA GTAGATTTTG

10651 CTCTGCTTCC TTGCTGCACC TCCTAGGGAT ATCCTCACCA AAAGGGGAAT

10701 TCAGGAGTCA CTGGCTTCTG GACCAATGTG TTTCCTGATA GTAACACTCC

10751 CACACCTCAC CTCAACAGGG AGAATCTGCA TGGTCCATCA TCAGGATTGA

10801 GCCTCTATCC TGATCATCCC TCAGAATTCC CTGCCCCTCC CTTTCATTTA

10851 GGTGTTAAAT TCTGTCCCCA GAATTCTCT CAAGACAATC ATGCCTCATC

10901 CAAGTGCTTT CATCCCTGTT CTAGCTCTT CACTGGTCTC AAGTCTGGGC

10951 TCTCCTGTCC CCATGCTATG AGAATGCAGG TTTCACCTTG CACTTTTATA

11001 AGCATGGTTG TATCTGTGAC TCTGTGCACA GTCCCAAGCA AGCCAGTAGT

11051 CCATGCACTC AGAGAATCTA AGTGTAGCTT CTCACCTCTT TCCCAGGTTT

11101 CTCATTTCCT CTGGTTCTTT ACTGTCTTTC CATCAGCAGT CTCAGGACAC
```

Exon R3
```
11151 AACCTAAGTA ATCTTTTCAT AGTCATTCTC CCCACCTACC TTCCCCAGGT

11201 CTGAGAAGGA TGGAGCAGCC ACTGGAGTGG ATGCCATCTG CATCCATCAT

11251 CTTGACCCCA AAGCCCTGG ACTCAACAGA GAGCGGCTGT ACTGGGAGCT

11301 GAGCCGACTG ACCAATGGCA TCAAAGAGCT GGGCCCCTAC ACCCTGGACA

11351 GGAACAGTCT CTATGTCAAT GGTGAGCAGC TGTGATGTGG TTGGAGTCTT

11401 TTCCTTCTAG AGTCTGGAAA GAATCTAATC TGTGGCTTGA AGTCACACTC

11451 CCTGCCTGGC CATTGAATAT TCTGTCATGT GGTGTAGATG GGATGACAAA

11501 GTTCTGGACT TCACAGTTTC TTCATTGTCG TGAACTGTGT TCCCTCAGGG

11551 CACTCTTCCC TGTTGTGAGG ATACTGATAG GAATTCTTTA ATGGCCCCAG

11601 TCCCATGAAA CTCATTGTCC CATGAAACTC ATTTAATTGC ATTGGGATTG

11651 CCATGACCTT ATTGTGTCCC TCGTATCTCC TTAACGCTTA CCAAGTCTCC
```

Exon R4
```
11701 TCCCTCCTTC TCTATGCAGG TTTCACCCAT CGGACCTCTG TGCCCACCAC

11751 CAGCAGTGAG TATTCAACTC ATGTCCACAT GCCCCTGATC CTACATTAAG

11801 TGGAGCAGGA GCTGGCCCCT CCTCTTAAAC CCATAAGTCC TCCTCTTGAG

11851 CAAAGGAGCT GGGAAGGCAG AAGTTATTGA AGCTCCCTTC CACCTAGCTC

11901 CAAAGACAGG CCCAGCTCAT GCCCGTATGC AGCAGACCTC ATAATAGTCT

11951 ACCTTCTTGC CATTTCTGCC ATGAGATTAT TTTCTGCTTT CACTGATGAG
```

Exon R5
```
12001 CACTTTTTCT CAGCTCCTGG GACCTCCACA GTGGACNNNN NNNNNNNNNN

12051 NNNNNNNNNN NNNNNNNNNN NNNNNNNNNN NNNNNNNNNN NNNNNNNNNN

12101 NNNNNNNNNN NNNNNNNNNN NNNNNNNNNN NNNNNNNNNN NNNNNNNNNN
```

TABLE 28-continued

Genomic Repeats
(SEQ ID NO: 312)

Exon R1
12151 ATTTTCAATT CCCACTACAG CTGCTGGCCC TCTCCTGGTG CTGTTCACCC

12201 TCAACTTCAC CATCACCAAC CTGAAGTATG AGGAGGACAT GCATCGCCCT

12251 GGCTCCAGGA AGTTCAACAC CACTGAGAGG GTCCTGCAGA CTCTGGTTAG

12301 TGCCCTTCCC TCCTCACTCT GCCCAGCCCC AGATATCCAG TCCCTTCTAC

12351 ATCATCCATG CCAGGGTGAT GAAAGAAGAT AGCAACAACT TCCCCCCTTC

12401 CCCCCAAGAG ATGCAAGCCC CACCCACAGA GACCAGTCCT GCTTATTGGT

12451 GCCTGCTCCA CCCACCTCAC ATCTGCCCCG ACACACACAC ACCTTAGCCC

Exon R2
12501 CACTACTCAC CTCCCTCTCC CTCCTCTACA GCTTGGTCCT ATGTTCAAGA

12551 ACACCAGTGT TGGCCTTCTG TACTCTGGCT GCAGACTGAC CTTGCTCAGG

12601 TGAGACTTTA GAAGAGCCAG CCTGGGTGCC CAAACTTGTT CCCACTCTAA

12651 AAGACTTTGC ACTGCTTCCT TGCTGCACTT CCTAGGTATA TCTTCACCAC

12701 AAGGGGAATT CAGGAGTCAT TGGCTTGAGA ACCAGTTGTT TCCTGATAGT

12751 AACACCCCCA TGCCCCAACT CAACATGCAA AATCTTCATG GTTCATCATC

12801 AGGATTGAGA CACTACCCTG ATTACCCATC TGAATTCCCT CCTTTCCCTG

12851 ACCCCTCCCT TTCATTTAGG TGTTAAATTC TGTCCCCAGG ATTTCTCTCA

12901 AGATAACCAT GCCTCATCCA CATACATGCA TCCGCCTTTC AAGCTCATCA

12951 CTAGTCTGAA GCTCTGGGTT CTCCTGTTCC CATGCCATGA GAATGCAGGT

13001 TTCACCTTGC ACTTTTATAA AAATTATTAT ATCCATGACT CTGCTTGCAG

13051 TCCCAGACCA AGATAGTGGT CTATGTACTC AGATAATCTA AGTGCAGATT

13101 CTCACCTCTT TCCCAGATTT CTCATTTCCT CTGGTTCCTT GATATGTTTC

13151 CCTCAGCAAT CTCAAGACAA GTCCTAGGCA ATCTTTTCAT TGTCATTCCC

Exon R3
13201 CCTCCTACCT TCCTCAGGTC CGAGAAGGAT GGAGCAGCCA CTGGAGTGGA

13251 TGCCATCTGC ACCCACCGTC TTGACCCCAA AAGCCCTGGA GTGGACAGGG

13301 AGCAGCTATA CTGGGAGCTG AGCCAGCTGA CCAATGGCAT CAAAGAGCTG

13351 GGCCCCTACA CCCTGGACAG GAACAGTCTC TATGTCAATG GTGAGCAGCT

13401 GTGATATGGT AGGGGTCTCT TCCTCCTGGC TGTGCAACCA TCTAATCTCT

13451 GGCTTGGGGG CACACTCCCT GCCTGGCCAT TGAAAATTCT GTCACGTGCT

13501 CTACATGGGA TGACTAAGTT CTGGACTTCA TGGTTTCTTT GTTATCATGA

13551 GAGGCATTCC CTCTGGGCAC TCTTCCCTGT TGTGAGGATG CTGATAGGAA

13601 ATCTTTAATG ACCCCTGTCC CATGAAACTC ATTTAATTGC ACCAGGGTAG

13651 TCCTGAACTC TATCGCGTCC CCCACATCTC CTTAACCCTT ACCCAGTCTC

Exon R4
13701 CTCCCTCCTT CTCTATGCAG GTTTCACCCA TTGGATCCCT GTGCCCACCA

13751 GCAGCAGTGA GTATTCAACT CATGTCCATG ATGCCCCTGA TCCTACATCA

13801 AGTGGAGCAA GAGCTGGCCC CTCCTCTTTA ACCCATAAGT CCTCCTCTTG

13851 AGCAAATGAG CTGGGAAGGC AGAAGTTACT CAAGCTCCCC TCTGCCCCAG

13901 CTCCAAAGAC AGACCCAGCT CAAGCCCACA TGCAGCAGAC CTCATAATAG

13951 TCTATCTTCT TGCCATTTCT GCCATGAGAG TGCTTTCTGC TTTCACTGAT

TABLE 28-continued

Genomic Repeats
(SEQ ID NO: 312)

```
Exon R5
14001 GAGGACTTTT TTCAGCTCCT GGGACCTCCA CAGTGGACCT TGGGTCAGGG

14051 ACTCCATCCT CCCTCCCCAG CCCCACAAGT AAGTACCAGC CAATGGTATC

14101 TGTATTAGAT CATGCCTGAT GAATGCAAAC ATCTGTGCCA TTTTCAGTCA

14151 AATGAAAATG GAAAATCATA ATAAATCTAG TGATACTGAG TGAACCAAAA

14201 AAAATGTATT GGCCACCTAC AGTGTACCAG ACCCTAGGGA TATAGCAAGG

14251 AAAATAGAAC CAATAAAAAC ATCTCTGCCC TCAGTGAGCT TGTGTTCATG

14301 TGATGATATG ATGGTGGTGG TGGTGGTAAT AGTAATAATG ACATATTCAG

14351 TTTGATGATA ATTTATGATT ATGGTGTTGC TGTTGATGAT GGTGGTGGTG

14401 ATGTTACTGA CAATGATGGT GACGGATCTT TGAGGATATT GTCCGTGATG

14451 GTCGTGAAGA TTATGATGAT AATGATGATG TGTTAAGTGT GATGATGATG

14501 ATGATCTGTG GTGATGCTGT TTAGGATGCT GTTCCGTGGT ACCGATGATA

14551 TTGATGTTGG TCGTGGTTAT GTTGTATGAC AATGACAATG ATGGTGATGA

14601 GGATAATCGC CAGTGATGGT GTGGGTTTAT GATGATGATG ATGTGTTGAA

14651 TGTGGTGATG ATAATGTTCG TGGTGGTCGT GATGGGCATT ACTATGGCAG

14701 TGATGGTCAT AATAATGATG GTGATGGTGA CAATGATAGC AAGGATGATG

14751 ATGGCAATAA AGATAGTACA TAACATCAGA CAATATTGAG CTCTGAATAT

14801 GCACCACGAG GAGTGCTCAG CATCTAAATA CTATTATATA ATATATTTTT

14851 GTAAAAATAA ATTGTATTGT TTTAGGCAAG GGAAGCATGG TAAATATTTT

14901 GTCACTCAAT TTAAATTCTG CATATGTTTA AAGATAAGTC TATTGCAAAC

14951 TCCTATTTTC TCTACTTTGG ACATAGTGTT TGTTTCCCAC CTCCACTACA

Exon R1
15001 GCTGCTGGCC CTCTCCTGGT GCCATTCACC CTCAACTTCA CCATCACCAA

15051 CCTGCAGTAC GAGGAGGACA TGCATCACCC AGGCTCCAGG AAGTTCAACA

15101 CCACGGAGCG GGTCCTGCAG GGTCTGGTTA GTGCTCCACC CTCCTCACTC

15151 CGCCCCACCC CAGAGAGTCA GTACCTCCTA CATCATCCAT GCCAGGTGAT

15201 GGAACAAGAT CATACCCACC TCACCCTTGC CCCAAGAGAT GCAAGCCATG

15251 CCCATTGAAA CCAGCCCCAC TCACTGATGC CTGTTACTGC CCCACCTGAC

15301 TTCTGCCCTA CACACCCACA CACGCAACTT AGCCCTCCTA CTCATCTCCT

Exon R2
15351 TCTCCCTCCT CCACAGCTTG GTCCCATGTT CAAGAACACC AGTGTCGGCC

15401 TTCTGTACTC TGGCTGCAGA CTGACCTTGC TCAGGTGAGA CCTTAGAAGA

15451 TCAAGCTTGG CTGCCCCACT TGTTNNNNNN NNNNNNNNNN NNNNNNNNNN

15501 NNNNNNNNNN NNNNNNNNNN NNNNNNNNNN NNNNNNNNNN NNNNNNNNNN

15551 NNNNNNNNNN NNNNNNNNNN NNNNNNNNNN NNNNNNNNNN NNNNNNNNNN

Exon R1
15601 NGTGTTAGTC TACTTTTGAA CACTGTTTAT TTCCCATCTT CACTATAGCC

15651 GCCAGCCCTC TCCTGGTGCT ATTCACAATT AACTTCACCA TCACTAACCT

15701 GCGGTATGAG GAGAACATGC ATCAGCCTGG CTCTAGAAAG TTTAACACCA

15751 CGGAGAGAGT CCTTCAGGGT CTGGTAAGAG CCCCACATAC CTCATTCTAC
```

TABLE 28-continued

Genomic Repeats
(SEQ ID NO: 312)

```
15801 CGCCACTCAC CATGTTTAGT CCTGCCCACC TCACCTATTG CAGAGCATGG

15851 AAGATCTCAT CTACCTCATC TTGCCCCCAG ATATGCATAC CCCAACCACT

15901 GATGCCAGCC CCACCAACTG TTGCCAGCCC TGCCCACCTC CCTTCTACCA

15951 CACCCCTATG ACTTCAGTCC TCCCACTCAC CTCCCTCTCC CTCCTCCACA

Exon R2
16001 GCTCAGGCCT GTGTTCAAGA ACACCAGTGT TGGCCCTCTG TACTCTGGCT

16051 GCAGACTGAC CTTGCTCAGG TGAGAACTGA GAACAGCCAG TCTGACTGAT

16101 CTGAGCAGTT TGACCTGCTT CCCTTCTGCA CTCCCTGGAG ATGTCCGCAG

16151 CCAGGTGGAA TCCAGGAGGC AGTGGCTCTA AGACCAATGT GCTTCCTGTT

16201 CCCACCACCT CCCACCTCAA CTGAGAGATG CAGAGCCCAT CAGCAGGACT

16251 GAGCTTCTAC CTTGGTCATC CCTCTGAATT CCCTCCTTTC CCCTACCTGC

16301 CTTTCCACAA GTGGTTCAAT TCTGTTCCCA GGATTTCTCC CAAGAAAAAC

16351 ATGCCTCGTC CACTTGCTTT CATCCCCAAA CCTAGCTCTT CACCTGTCTC

16401 AAGTATGAGT TCTCCTTACC CCATGCTACA AGAATGCAGT TTCCACTTTG

16451 CAATTTTATA AAAATCCTTG CATCCATGAT TCTGCTCATA GTTGCTAAGA

16501 GTCAGTGCAC TCAGAGAATG GAAGTATGGC TTCTCACTTC TCTACCAGGC

16551 TTCTCATTTC CTCTGGCCCC CTCCTGTCCT GCCCTGTGGG ATCTCAGAAC

16601 CCCTCCCTAG GCAATCCGTG TATTGTCTTT CCCCAATCTT GCCCTCCCCA

Exon R3
16651 GGCCCAAGAA GGATGGGGCA GCCACCAAAG TGGATGCCAT CTGCACTTAC

16701 CGCCCTGATC CCAAAAGCCC TGGACTGGAC AGAGAGCAGC TATACTGGGA

16751 GCTGAGCCAG CTGACCCACA GCATCACTGA GCTGGGCCCC TACACACTGG

16801 ACAGGGACAG TCTCTATGTC AATGGTGAGT AGTTGTGATG TGGTTGGAGT

16851 CTCTTCCTCC TTGCTGGGCA GCCTCTACTC TCTGCCTTGA GGTCACGCTC

16901 CCTGCCTGGC TATTGAATGC TCATCCATGT TGTCTGTATG TGATGGCTGA

16951 GGTTGGAACT TCATGGTTTC TATTTCATCT TGGACTGAGT TCATCCTCAG

17001 GATCTGCTTT CTGGATCTGA GGGTGCTGAT AGAGAATCTT CAATGGTTCG

17051 TGTTCTGGGA AATTCCTTCC ATTGCACCAG GGTACCCTGA CCCCTATATA

17101 GTTCCCCACC ACTCCCTTAA CCCTTACCCA CCCTCTTCCC TCCCTCTCTA

Exon R4
17151 TGCAGGTTTC ACACAGCGGA GCTCTGTGCC CACCACTAGC AGTGAGTATC

17201 CACTGATTTC CAGTGCTCCT GATCCTACAT CATGCAGGGC AAGAACTGAC

17251 CCCTCCTCAC ATGCCCTAT GTCCTCTATG AGCAAAGGAG CTGGGACAGC

17301 ACAAGTTACT CCCTTTCCCT TCTGGCCCAA GTCTCTTCAG AGAGAGACCC

17351 AGCTCAAGCC CCACATGCAG CAAGGTCCAT AAATACTCCT ACCTGCTGGC

17401 ATTTCTGCCA TGAGAGGGTT CAACACTTTC ACTAATGAGG CCTTCTCCTC

Exon R5
17451 AGTTCCTGGG ACCCCCACAG TGGACCTGGG AACATCTGGG ACTCCAGTTT

17501 CTAAACCTGG TCCCTCGGGT AAGTACAAAT CAATCGCATC TCTGTTAGAG

17551 CATGCCTGAT GACTGTCAAC ATCTCTGCCA TTTTCACTTA AATAAAGATA

17601 AAAAATCCTA GTGAATCTAC GGATGAGGAG TCATCCAGCA AACTTAATTG
```

TABLE 28-continued

Genomic Repeats
(SEQ ID NO: 312)

```
17651 AGTGCCTAGT TTCTGCAGGG CTCTAGGGAT AAGAAAGGGG ACACAAAACA

17701 GTTAAAAATA TCTGCTGCAA GAAAGCTTAT TTTATTGTGA GGGTGATGGG

17751 AGTTGGTGGT GGTGAAGTTA CTGGAGATGA TGACAATAAG AATGGTGATG

17801 CTAGTGATGA TGATGGTGAT AAGGATGATA ATTATGAAGA TGGTGGTGGT

17851 GATGATGATG ATGGTNNNNN NNNNNNNNNN NNNNNNNNNN NNNNNNNNNN

17901 NNNNNNNNNN NNNNNNNNNN NNNNNNNNNN NNNNNNNNNN NNNNNNNNNN

17951 NNNNNNNNNN NNNNNNNNNN NNNNNNNNNN NNNNNNNNNN NNNNNNNNNN

18001 NNNNNNNNNN NNNNNNNNNN NNNNNNNNNN NNNNNNNNNN NNNNNNNNNN

18051 NNNNNNNNNN NNNNNNNNNN NNNNNNNNNN NNNNNNNNNN NNNNNNNNNN

18101 NNNNNNNNNN NNNNNNNNNN NNNNNNNNNN NNNNNNNNNN NNNNNNNNNN

18151 NNNNNNNNNN NNNNNNNNNN NNNNNNNNNN NNNNNNNNNN NNNNNNNNNN

18201 NNNNNNNNNN NNNNNNNNNN NNNNNNNNNN NNNNNNNNNN NNNNNNNNNN

18251 NNNNNNNNNN NNNNNNNNNN NNNNNNNNNN NNNNNNNNNN NNNNNNNNNN

18301 NNNNNNNNNN NNNNNNNNNN NNNNNNNNNN NNNNNNNNNN NNNNNNNNNN

18351 NNNNNNNNNN NNNNNNNNNN NNNNNNNNNN NNNNNNNNNN NNNNNNNNNN

18401 NNNNNNNNNN NNNNNNNNNN NNNNNNNNNN NNNNNNNNNN NNNNNNNNNN

18451 NNNNNNNNNN NNNNNNNNNN NNNNNNNNNN NNNNNNNNNN NNNNNNNNNN

Exon R1
18501 NNNNNNNNNN NNNNNNNNNN NNNNNNNNNN NGCTGCCAGC CCTCTCCTGG

18551 TGCTATTCAC TCTCAACTTC ACCATCACCA ACCTGCGGTA TGAGGAGAAC

18601 ATGCAGCACC CTGGCTCCAG GAAGTTCAAC ACCACGGAGA GGGTCCTTCA

18651 GGGCCTGNNN NNNNNNNNNN NNNNNNNNNN NNNNNNNNNN NNNNNNNNNN

18701 NNNNNNNNNN NNNNNNNNNN NNNNNNNNNN NNNNNNNNNN NNNNNNNNNN

18751 NNNNNNNNNN NNNNNNNNNN NNNNNNNNNN NNNNNNNNNN NNNNNNNNNN

18801 NNNNNNNNNN NNNNNNNNNN NNNNNNNNNN NNNNNNNNNN NNNNNNNNNN

Exon R2
18851 NNNNNNNNNN NNNNNNNNNN NNNNNNNNNN NNNNNNNCTC AGGTCCCTGT

18901 TCAAGAGCAC CAGTGTTGGC CCTCTGTACT CTGGCTGCAG ACTGACTTTG

18951 CTCAGGNNNN NNNNNNNNNN NNNNNNNNNN NNNNNNNNNN NNNNNAGAAT

19001 TCAGTCGACC TACCGGCTTT GATGATTGCT CAGTTGAACT TAGAAATGCA

19051 CTGTCTGCCC AATGGTCCAG TCTCATGAGT GTGACTCTTT TCTGCCTCTC

19101 TTGGGTATCT GATCAAGATG GACTCAGGAA AAGTGCTCCA GATAACTGTC

19151 TCCAATATAA CACTGCCCCT GCCATCACAC CCAAATGACT GGAAGTTTCA

19201 CAGGGTCATC AGCAGGGATT GGACTTCCAC CCCGGCCATC CCTCTGAATT

19251 TTCCCTCTTT TCTCCCCACC TCCCTTGCCC TTAGGTGTTA AAATTCTCTA

19301 ACTAAGATTT CTCTCAAGAC AAATGTGCCT CATTCACTTG TTTAATTCCC

19351 AATTCCAGCT TGTCACCTGT CTCAAGTCTA GGCTGTCCTG TCCCCATGCC

19401 ATGAGAATGC AAGAACCACA CTGAAATGTT AGAAAAATTC TTTTATCCAC

19451 AAGTATGCTC ACCGTCCCAA GCTGGACAGT AGTCAGTGCA CTCAGAGAAT
```

TABLE 28-continued

Genomic Repeats
(SEQ ID NO: 312)

```
19501 CTAAGTGTGG CTTCTCATCT GTGTACCAGG CTTCTCATTT CCTGTGGGCC

19551 CTTCTTGTCC TTCCCTCCGC AATCTTGGGA CTCCTCCCTA GACAAAACTT
```

Exon R3
```
19601 TATTATTATT CCCCTCACCT GCCCTCTCCA GGCTGAAAA GGATGGGACA

19651 GCCACTGGAG TGGATGCCAT CTGCACCCAC CACCCTGACC CCAAAAGCCC

19701 TAGGCTGGAC AGAGAGCAGC TGTATTGGGA GCTGAGCCAG CTGACCCACA

19751 ATATCACTGA GCTGGGCCCC TATGCCCTGG ACAACGACAG CCTCTTTGTC

19801 AATGGTGAGC AATTGTGATG TGGTTGGAGT TTCTTCTTCC TTGCTGAGCA

19851 GGCCTCTACT CTCTGTCTTG AGGTCACTCT CCCTGCCTGG CCACTGGTCT

19901 TGGCCATGTT GTCTGTATTT GATGATTGAT ATGAACTTCA CCGTTTCTTC

19951 TTCATCTTGT ACTGGAGACC TTCATCCTCA GGACCTTCTT CCCTGATCTG

20001 AGTGTACTTG TATAGAATCC TCAAAGCCCA TGTTCCCTGA AACTCCTTCA

20051 ATTGCACCAT GGTAGCACTG ACCCCTTTTG GTCCCCCACC TTNNNNNNNN
```

Exon R4
```
20101 NNNNNNNNNN NNNNNNNNNN NNNNNNNNNN NNNNNNNNNN TTCACTCATC

20151 GGAGCTCTGT GTCCACCACC AGCACTNNNN NNNNNNNNNN NNNNNNNNNN

20201 NNNNNNNNNN NNNNNNNNNN NNNNNNNNNN NNNNNNNNNN NNNNNNNNNN

20251 NNNNNNNNNN NNNNNNNNNN NNNNNNNNNN NNNNNNNNNN NNNNNNNNNN

20301 NNNNNNNNNN NNNNNNNNNN NNNNNNNNNN NNNNNNNNNN NNNNNNNNNN
```

Exon R5
```
20351 NNNNNNNNNN NNNNNNNNNN NNNNNNNNNN NNNNNNCCTG GGACCCCCAC

20401 AGTGTATCTG GGAGCATCTA AGACTCCAGC CTCGATATTT GGCCCTTCAN

20451 NNNNNNNNNN NNNNNNNNNN NNNNNNNNNN NNNGACTCCA GCCTCGATAT

20501 TTGGCCCTTC AGGTAAGTAC CAGTCAATGG CACCTCTATT AGAGTATGCA

20551 TGATGAGTGT CAACATCTCT GTCCTTTTCA CTCAAATAAG ATTAAAAATC

20601 ATAGCAAATT GTACGTGATG ATGAGTCACC CAACAAACTT CTTTGAGTAC

20651 CCACTCTCTG CCAGGCCCTA GAGATAAGGC AGGGAACACA AAAGAGGTAA

20701 AAATCTCTGC CCTCAGAGAG CTTCTTTTAT TTTGAGGATG ATGTGGGATA

20751 GTGGTGATGA TGATGTTGCT GGAGATGATT ACAATAATGA TGGTGATGCT

20801 TATGACCATG ATGTGATGAT GATGGTGATT ATGAAGATGA TGATGATGAT

20851 ATTGATGATG GTAGTGGTTT TGACAGTAAT GATGATGTGA TGATGATGAT

20901 GATAGTGGTG GTGGTGATTA TGGGAAGGAT GATAGTGGTG GTGGTGATGG

20951 TGGTGGTTGT GGTGGTGATT GACAATGTGG TGGTGATATT GACAATGAGG

21001 ATGATGATGA TAGTGGTGGT GGTTATGATG GTTAAGGATG ATGTGATGAT

21051 GGTGTTGGTG ATCACGGTAC TAGTGGTGGT GATGTGGACC GTCATGGTTG

21101 TGGTTGTGGT GGTGATGGTG GTGATCATGA TGATAATGAG GATGATGGTG

21151 GTGATTGTCA TGATGGTAAG GATGAAACAG TGATGGTGTT GGTGACCATG

21201 TTCCTGGTGG TGATGGTGCA GGTGATGATG TGGATGATGA TGGTGATGGT

21251 GGTGGAGATG ATAGGGATTA TGAATATGGT TCGGGTCTCT GACTGGTGGT

21301 GGTGATGACA ATAATGAAAA TGATGGTCAC AGTGTTGGTG ATGATGATGG
```

TABLE 28-continued

Genomic Repeats
(SEQ ID NO: 312)

21351 TGGTGATAAC AAAGGTAATA GATAGTGTCT AGTATTATGG AACACAGAAC

21401 ATCACCAAAG GTTATGCTCA GCATCTAACT ATTATTATTT AGCATGCTCT

21451 ATGAAAAACT TGATCGTTA TAGTCAAGGG AGGCATGAAA ACCTTCTATT

21501 TTATCACTCT CTTTAAATCT GGTTGCATAT GTTTAGAAAT AAATCTATTA

21551 CAAACTCTTA AATGTTCTCT ACTTTTGAAC ATAGTGTTTA TTTCCCACCT

Exon R1
21601 CCACTACA<u>GC TGCCAGCCAT CTCCTGATAC TATTCACCCT CAACTTCACC</u>

21651 <u>ATCACTAACC TGCGGTATGA GGAGAACATG TGGCCTGGCT CCAGGAAGTT</u>

21701 <u>CAACACTACA GAGAGGGTCC TTCAGGGCCT G</u>GTGAGAGCC CTGCCCACCT

21751 CACTCTGCCC TGCCCACCTT GTCTTGTTCC ACCTACGTCA CCCATTCCAA

21801 GGCATGGAAG AAGATCTCAC CCACCTCCCC TCACCTGAGA GATAGCCCCG

21851 CCCCCTGATT ACAGCCCCTT CCACCTTACA TCTTCCTCAC TTCTATGTCC

Exon R2
21901 TCAGCCATCT TACTCACCTC CCTCTTCCTC CTCCACAGG<u>C TAAGGCCCTT</u>

21951 <u>GTTCAAGAAC ACCAGTGTTG GCCCTCTGTA CTCTGGCTGC AGGCTGACCT</u>

22001 <u>TGCTCAGG</u>TG AGAACTGAGA ATAACCAGTC TGGCTACCCC AAGTGTTCCC

22051 AGGCCCAAGG AGTTTCATCA GCTTTCTTCC TTCCCTCCCT ATGGAAGTCC

22101 TCAGCACAAG TGGAATTCAG GCGTTGGTGG CTCCAGGATG AACATATCTG

22151 CTGATCCTAC CACCTCCCCC ATCAATCGAG AGAATTTGCA GGGCCCATCA

22201 GCCAGATCAG GCTTCTACTT TGGTCATCCT TCTGAATTTC TTACTTCTCC

22251 CTACCTCCCT CTCCTTCAGG TGTTAAATTC TCTTCCAAGG TTTCTCTCAA

22301 GATAAACATC CCCCATCCAC TTGCTTTCAT CCCCAATTCC AGCTCTTAAT

22351 ATTTCTCAAG TCTGGGCTCT CCTGTCCCCA TACCATGAGA ATGCAATTTT

22401 ATAAAATTCT TGTATTCCTG ACTCTACTCA CATTCCCAGG CTGCCTGGAA

22451 GTTGGTGCAT TCAGAGAATC TTAGTATGGC TTCTCACCTG TCTACCAGGA

22501 TTCTCATTTC CTCTGTCCCC TTCCTGTCCT GCCCCCAGGA ATCTCAGGAT

22551 GCCTCCCCAT AGGCAATCTA TTTAATGTCA TCCCCCTTAT CTGCCCTCCC

Exon R3
22601 TAGG<u>CCAGAG AAAGATGGGG AAGCCACCGG AGTGGATGCC ATCTGCACCC</u>

22651 <u>ACCGCCCTGA CCCCACAGGC CCTGGGCTGG ACAGAGAGCA GCTGTATTTG</u>

22701 <u>GAGCTGAGCC AGCTGACCCA CAGCATCACT GAGCTGGGCC CCTACACACT</u>

22751 <u>GGACAGGGAC AGTCTCTATG T</u>CAATGGTGA GCGGCTGTGA TGTGGTTGGA

22801 GATTCTTCCT CTTTGCTGGA CAGCTTCTTA CTCTCTGACT TGAGGTCACA

22851 CTCCCTGACT GGCCATTGAC GTCTTGGCTA TGTTGTCTGT ATGTGATGAC

22901 TGATGTCTGA ACTTCATAGT TTCTTCATCT TGGACTGAGT TCATCCTCAG

22951 TACCTTCTTC CCTGATCTGA GGGTACTGAT AGAGAATCTT CAAAGGCCCC

23001 TGTTCCTTGA AACTTCTTCC ATTCCACTAG GGTATCTGTG ACCCCTATTT

23051 GATTCCCCAC CTCTCCCTTA ACCCTTACCC ACTCTCCTCC CTCCTTCTCT

Exon R4
23101 GTGCAGG<u>TTT CACCCATCGG AGCTCTGTAC CCACCACCAG C</u>AGTGAGTAT

23151 TCAACCGATG CTCCAGTAGC CCCAATTATA CACCAAGCAG GGCAGGAGCT

TABLE 28-continued

Genomic Repeats
(SEQ ID NO: 312)

```
23201  GTCCTGTCTT CCTATGCCCC TATGTCCTCT TCATAAAGGA AGGGGCTGGG
23251  AGGGCACAAG TTATTCCCTT TCCCTTCTGG CCAGCTCCAG AGAGAGACCC
23301  AGCTCAGGCC CGATATGCAG CAAGGCCTGT AAATAGTTTT ATTTGCTGAC
23351  CTTTCTGCCA TGAGAGGCTT GGATGCTTCC CCTGAAGAGG GTTTCTCTGT
23401  AGCTCTTGGG ACTACCACAG TGGACCTGGG AAACTCTGGG GATCCACCCC
23451  TTCTACTGGT CCCTTGAATA AGTACCAGCC AATGGCACCT CTGTTAGAGC
23501  ATGGCTGATG AGTGTAAACA TCTCTTCCAT TATTCAGTCA AATAAAGATG
23551  GAAATTCTTT ATAAATCTAG TGATGATGAG CCAACCAACA AACTTTATTG
23601  AGCATTGTGA CAAGCCCTGG GGCTCTGCCA AATCCTGGGG ATATGGCATG
23651  GATCATGAAA CAATTAATAA TCTCTCCTCT CAGAGAGCTA TTTTTATGAT
23701  GATACTGATG GTGGCAATGA TGATGATGTT GATGGTGATT ATGACCATGA
23751  TGACAATGGT GATGGTGGTG GTGATGATGG TAATGATGAT GATGGTGATG
23801  TTGGTAATGA TGGTGGTGAT TATGACAATA ATGATGGTGA TGGTGACAGG
23851  GATGGTGATG ATTATGATGG TGGTGGTGAT AACAAAGTTA ATGGATAATA
23901  TATGAACTTA TTGGCTACTG AATATGCACC AAAGTGCTAT GCTCAGTGTT
23951  TAACTAGTAC TATTTAATAT GATTTCTAAA AAAAATCTTG AATTATTATA
24001  GGCAGAAGAA TCATGGGAAC CTTTTATTTT GTCACTCACT TTAAGTCCTA
24051  TTGCATATTT TTTAAGTCAA TTGCAAACAC AGTTTCTCTG CTTTGAACAT
24101  TGTGTTTATA TCCAGTCACC CCAATAGTGC ATAAACCTGC TGATTGGAGC
24151  AACTGTGTCT TACTCCCTTG TGCTTCCCTA GTATCTGCTT CAGGACCTTG
24201  TACATGGTAG ATCGACAGAT TTAGATCTAC AGGAAAATAT GGATTTTCCC
24251  AGGGAAGGAA GGAATGAAGT ATGCTTTCTT ATAATGTATG GAAACTTTCC
24301  TCTTCTGCCT TGGTTCAACT TTAGTGTCTG CCAGAGTTTA CACTGGAAAA
24351  CTATATGGCA TCTGCTCCAC TCCCTCATCC ATGACAGACA TCATTAATTG
24401  ATTGCAGCAT TCATGGCAGA CATCACCAAT TGATAATAGC ATTCATTTTC
24451  TCTCAGTTCA AAACAGCTTC AGAATGGTTA CCAAAAAAAA AAAATTCAGT
24501  CGCTACCAAT TCAATTGGAG CTGACTCAGG ATTATGGGAC AGAATTCAAG
24551  AGAGTTAGGT TCCTTGATGA TGTGTAGTGG CTATTTGTTT TCCGGTCCAG
24601  GCTAATNNNN NNNNNNNNNN NNNNNNNNNN NNNNNNNNNN NNNNNNNNNN
24651  NNNNNNNNNN NNNNNNNNNN NNNNNNNNNN NNNNNNNNNN NNNNNNNNNN
24701  CTTTGTGCGG CAAAGTTCAG GGGCCCCAAA AATTTCTGTG CCCCAATCAT
24751  GGCGGACCTA GGTTTAGGCA CAAATTCCAG GGATTAAGTC CCTGGAGATG
24801  TTATGGCTTT TGGTTTTCCT AGAAAGGCTC AGCTCAGGCT CAGCTTGGTC
24851  ATGCTGATAT CCTTTCTTCC ACTTGGTCGA TTTGGCTGTT GATACTTATG
24901  TATGCTTCAC GAAGTTTTTG TGCTGTGTTT TTCAGCTCCA TCGGTTGGTT
24951  TATGTTCCTC TCTAAACTGG TTATTCTAGT TAGCAATTCC TTTAACCTTT
25001  CATCAAGGTG CTTAGCTTTG CATTGCATTA GAACATGCTC CTTTAGCTCA
25051  TCGTACTTTT TTATTGCCCA TCTTCTGAAG CCTACTTCTG TCAATTCATC
```

TABLE 28-continued

Genomic Repeats
(SEQ ID NO: 312)

```
25101  CATCTGATCC TCCATCCAGT TCTGCACCCT TAATGGAGAG ATGTTGCGGT

25151  CATTTGGAGG AAAAGAGGCA CTCTGGCCTT TTGGGTTTTC AGCATTTTTT

25201  TGTTGATTAT TTCCCATCTT CAGGAGTTTT AGTTTCAGGC TTTGAGGCTG

25251  CTGATCCTTG GATGGGTTT TTATGGGGGT CTTTTGGTTG TTGTTGTTGA

25301  TGATGATGAT GTTATTGTCA CTTTCTGCTT GTTTTTCTTT CAATAGTCAG

25351  GTCCCTCTTC TGTAGGGCTG CTGCAGTTTG CTAGGGGTTC ACTTCAGGCC

25401  CTATTCATCT GATTCGCTCC CATGTCTGGA GGTGTCACTC AAGGAGGCTT

25451  GGAGAGCAGC GAACATAGGT GCCTGCTTCT TCTGGGACCT CTGACCTCGA

25501  GGGACACCAA CCTGATGCCA GTAGGATCGC TCCTGTGTAG GGTGTCTGAC

25551  AACTATTGTT GGAGGGTTTC GCCCAGTTGA CTGGCATGGA GAGCAGGACC

25601  CATTTAATGA AGCACTTTGT CCCCTGGTGG AGAGGGGTT CTTCACTGGG

25651  GGGAAACCAC ATGTCTGGGC TGCTTGGATT CCTCAGAACT ACCAGAGGAG

25701  AGGCTAAGTC TGCTGGTCCA CAGAGACTAC AGCCATCCCT CCCACTAGGG

25751  GCCCAAGCCC AGGGAGTCCA AATTCTGTCT CTGAGCCTCT GGCTGGAGTC

25801  TTTGGAGATC CTGCAAGGAA GCTCTGCCCA CTGAGGAAGG ATGGGTCAGG

25851  GTTAGCCCTG AAGAGGCACT CTGGCTGCAG ACTGCCACAG CCGGTGTGTT

25901  GGGCTGTGGG GACAAGTCTT GGGACCAAGC CGTCCAGCCT ACCCGGCTCT

25951  AGCAGGGGAA AAGTACAGCC TGGAGCTATT GAAAGGGGTG CCGCCCTTCC

26001  CCCGCCCAGG GAGCTTAGCG TGTTAGGCAG TTGTGAGTCC AGTGCTGGCT

26051  GTCGCCCCTT CCCCAAGGAA CAAAAAGAC TTAGCAGGCA GCCGCAGCCA

26101  GTGCTGGTCG CCCCTCCCCC GGGGAGTTCC GTAGGCTTAG GCAGATTCCA

26151  GCTGTAAGAA TCTGCGTGTT CTGGGGTTGG GACACTAGGT CCCAGTGGCA

26201  TGGGTTCGCG AGTGAGATCT TCCAATCTGT GAGTTGCACA GTTCCGTGGA

26251  AAAAGCACAG TTTCCCCCTC TTGGGTAGCC CGCTCACTCA CCACCTCCCT

26301  TGGCTGGAAG GAGGGGGTTC CCCTTCCCCG TGTGTCTCTC AGGTGGGCCA

26351  CCACACCACA CTGCTCTTCC TTCTCTCTGT GGGTCACTGC CAGCCTTCTA

26401  GTCAATTTTG ATGAGGGAAC CTGGACATTT TGGTTGCCAG GAAGGATCAC

26451  ACACTTATTA CAGTTTTTTT CAATGTGAGC CTCTGAGCGC TGCTGCTTAT

26501  AGTCGACCAT CTTGGCCCCC AGAGTCACAC ATCTGTTATT TTTTGATGTT

26551  TTGATTGTGG CAATTCTTGC AGAAGTAAGG TGGTATCACC TTATGGTTTT

26601  GATTTCCCTG GTCATTAGTG ATGTTGAACA TTTTTTTCAT ATGTTCATTA

26651  GCCATTTGTA TATATTCTTT CAACAACTGT CTATTTATGT CCTTAGCCCA

26701  CTTTTTGATG GGATTGTTTT TTTCTTGCCA ATTTGTTTGA GTTCGTTGTA

26751  GATTCTAGAT ATTAGTCCTT TGTTGGATAT ATAGATTGTG AAGATTTTCT

26801  CCCACTCTGT GGGTTGTCTG TTTACTCTAC TGACTGTGAA GGAAAAGTCA

26851  ATTTCTTATA CGAATTTGTC TCACTCCTAC TTCCAAATGA GATCCTGGGG

26901  TTTTTTTTTT CTGTTAATCC TTCACAATAC TTCTCCCACT TTTTTGAACT

26951  CATTTGTTTA TATTCTGTTG TCTGCTTCTC TTTTATAGGA ATGTGACTTC

27001  TTATGGGCTT TCTCTATTAT ACCACATATG GGTTTTTGTT TTGTTTTGTT
```

TABLE 28-continued

Genomic Repeats
(SEQ ID NO: 312)

```
27051  TTGTTTTGTT TTGTTTTTGT CCTCGGATCC ATTCTCCAAC CTCCTCCAGC
27101  CTTCCCGTGC TCTGTGGGAT AGACGTCTGA CTCATGAAAA CTACATTTCC
27151  CAGGCTCCCA TGCTAACTAG CTTCCTGTTA GGTTCAGCCA ATAGGAGGCA
27201  TTGGTGGGAC AATGGTGGGC GGGGCTATGG AAGGGCCAGA GTATTTCTGT
27251  ACCCCGCCCC CCTGCTCCCC TTCCAATGTT CCTGGAGCGG TGTAGGACCA
27301  ATACTGTATA TATGGAAGGA AGGCAAGGTG GATAGATTGG AAGGAAGAAG
27351  TGACAGATGG AAAGAAGAAG TGATAAATGG CAAGCGAGGC AAGGGAGCAG
27401  AGGATGGATG AGTGGATTGC AAGAAAGAAA AAAATGGATG AAATATAAAA
27451  GGAGCAGGAC AGATGGATAA GTAGATGGAA GTAAGAAAAG ACTGGTGTAA
27501  GAAAGGAACG ATTGATGATG GATGATGAAT GGATCAGTGG TGATTGGGTG
27551  AAGGGATGAA TGGATGGATG GACAGATGGA TGAACAGATG GGTGGGTGGA
27601  TAGATGGATG GATGGATAAA ATGGGTAGGT GGATGGATGG ATGGATGGAC
27651  AGATGGGTGG GTAGGTGGAT GGATGGATAG ATGGATGGAT AAGTGAATGG
27701  ATGGATGGAT GGATGGATGG ATAAATGGAT GGATGGGTGA AAGGAAGGAA
27751  AGAAGTGAGA GAAGGAAGAG GAAGGATAGA CAGATGTTAG AAGGTACAAA
27801  TGAAAGGAAG GAAGCCAGCA AGAAAGAAAG GATGCATTAA TAGAATGAAA
27851  GATGGAAGGG AAGAAGAAAG GATGGAAAGA GAGAAGGAAG AATGAACAGA
27901  AGGAAGTTCA AGAGTGGTGA AAAGAAGAAA GGCAGGGAGA GAAGGAGAAG
27951  TAAACTTTTC TTCTAGAGAT TTGTCTTAAA CCTTAGCTTG GCTGGACACT
28001  GTGGTTCACG CCTGTAATCC3CAGCACTTTG GGAGGCCGAG GCGGGTGGAT
28051  CATGAGGTCA GGAGATCAAG ACCATCCTGG CTAACACGGT GAAACCCTGT
28101  CTCTACTAAA AATACAAAAA AAATTTAGTC AGGTGTGGTG GTGCATGCCT
28151  GTGGTCCCAG CTACTCAGGA GGCTGAGGCA GGAGAATGGC ATAAAACCTG
28201  GGAGGCAGAG CTTGCAGTGA GCCAAGATCA CACCACTGCA CTCTAGCCTG
28251  GGCGACAAAG TGAGACTCTG TCTCAAACAA AAACAAAACA AAAAACAAA
28301  AACAAAAAAC AAAACCAAAC CAAAACAAAA AAAAAAACCT TAACTCATAC
28351  TTTCATAAAG TTCCACACAC AGGGAGTGAT TAGAAAGCAT TTGCTGATAT
28401  ATTTTATATA ATAAACATGT ACACCATATT GACCTGTGTG CCCAGCAGTG
28451  CTTACATGAT TTACAATGAT TAACTTGTTT AAGCTTCATA ACAACGGTTG
28501  AGGCAGGAAA CATCATTGTG AACCATTGTC ATCTCATTTT ACAGATGAGT
28551  AAACTGAAGT GCTGAGAGGT TGGTTATGGC TGCAAAGATT GTTGGCCATG
28601  TTAACCAATG CATAGAAGAT TAGCATACCT GGTTGTGAGT GCAGGAGAGA
28651  GAGAGAAATG GGAGAAAGGC AGAGAAGGAT CGATGGGGAG AGAGGAAGAG
28701  AGAGAGAGAG AATAAATTTT TTAAAAATGT CTAGAGTCAT GACTTCCGCA
28751  TCAGTGTGGT AATATGCAGC CTTTACCCTG GGAAAGATCA GAACCATTGG
28801  TACTTTTTAC AGAATCTTCC CTTCCTGCAT TTGGGTAGAA GGACCCCATC
28851  TGGACATCCC AAATCATTAA GCACACCCTT ACTGGCTGCT GGAGTTGTCT
```

TABLE 28-continued

Genomic Repeats
(SEQ ID NO: 312)

28901 CCATTAAAAG TCACCGTTGG GTTTATTAAG AGGCGGACAC AGGGTCCTTA

28951 GAACACACTG CCCCCACCTG TCCCACACCA CCCCCCACCC ACCCATCATC

Exon R1
29001 CTCCCCAAGA GCTTCATCTC TCTCTCTCTT CCCCCTGCCC TAGCC<u>GGGGT</u>

29051 <u>GGTCAGCGAG GAGCCATTCA CACTGAACTT CACCATCAAC AACCTGCGCT</u>

29101 <u>ACATGGCGGA CATGGGCCAA CCCGGCTCCC TCAAGTTCAA CATCACAGAC</u>

29151 <u>AACGTCATGC AGCACCTGGT</u> GAGAGGCCTG CCTCCCGCTG CAGCCCTGCC

29201 ATGCCCATCC TAGGGCTGTT GCCTGCCTGC CTCTGACCAA CCCAAGCTCC

Exon R2
29251 CTTCTCCCTC TGCAG<u>CTCAG TCCTTTGTTC CAGAGGAGCA GCCTGGGTGC</u>

29301 <u>ACGGTACACA GGCTGCAGGG TCATCGCACT AAGGTGAGAA</u> ACTCCCCCAC

29351 CCACAGCGCA CCACCAAGAA CTTAGAGTTC TGACTGGGAG GTCCCTCTTG

29401 GGTTGGGGTG GGCTACATAT TTTTTTAAAT CTTTTTATCT TTCCTTTTTT

29451 TTTTTTTGAG ATGAAGTTTC GCTCTCGTTG CCCAGGCTAG AGTGCAATGG

29501 CACGATCTTG GCTCACTGCA ACCTCTGCCT CCCGGGTTCA AGTGATTATC

29551 CTGCCTCAGC CTCCCCAGTA GCTGGGATTA CAGGCAGGCA CCACCATGCC

29601 TGGCTAATTG TTTTGTATTT TTAGTAGAGA TGGGGTGTCT CCATGTTGAT

29651 CAGGCTGGTC TTGAACTCCT GACTTCAGGT GATCCACCCT CCTCAGCCTC

29701 CCAAAGTGCT GGGATTACAG GCGTGAGCCA CCATATCTGG CCCCATTCTT

29751 TTTTTTTAAA TGAATTTAAG GAGTGCAAAT GCAGTTTTTG TTACATGCAT

29801 ATATTCCATA GTGAAGTCTG CAGACAGTAG ACTTCCAGAC AGTAGCTTCT

29851 GGTGTATCAC CCGAATAGTG TACATTGTAC TTATTAAGTG AGGTTCCCCA

29901 CCCTTCTCCC ACTCTCCCAC CTTTCTGAGT ATCCAGTGTC TATTATTCCA

29951 CACTCCAGGT CCATGCTCTC ACGTATAAGT GAGAACGTAT GGTATTCCAC

30001 CATGAGCTAA TGGACATGGA GTCCATTGGC TCCCACTTAT AAGTGAGAGC

30051 ATGCGGTATT TGACTATTTC TGAGTTTCAC TTAAGATAAT GGACTCCCAT

30101 TCCATCCATG TTGCTGCAAA ATACATGATT TCACTCTTTT TATGGCTGAA

30151 TAGTATTTCG TGGTATATAT ATATACCACA TTTTCTTTAT CCAGTCTTCT

30201 ACTGATGGAC ACTTAGGTTG GGTCCATACC TTTGCTGTTG AAATAGTGCT

30251 GCAATAAACA TACACGTGCA GGTGTCTTTC TTATATAAAT GATTTCTTTT

30301 TTTCTTTCCT TTTTTTTGAT ATAACGAATT TCTTTTATTT GGGTTAAATC

30351 CCCCAATAGT GGGATTGNNN NNNNNNNNNN NNNNNNNNNN NNNNNNNNNN

30401 NNNNNNNNNN NNNNNNNNNN NNNNNNNNNN NNNNNNNNNN NNNNNNNNNN

30451 TGACCTGTCC GTATTGATAT ATAAAATGCT GCATTTAAAG TGTACAACTT

30501 GATATTTTGG TATACATTGT TAAATCATGG CCACATTTCA GCTAATTAAT

30551 ATATCTATTA TCTCTACATA GTTATCATGT TTGTACCCTT TGACCAGCAT

30601 CACCCCATTT GCTCCTCCTC CCAGCCCCTG GCAACCACCA TCCTACTCTC

30651 TGCTTCTATG AGTCTGACAA TTTTAGATTC CACCTATAAG TTAGATTATG

30701 CGGTATTTGT CTTTCTGTGC CTGGCTTATT TCACTTAGCC TAATGTCCTC

30751 CAGCTCCATC TATGTTATCC CAAGTGGCAG GATTTTCATC TTTCTTATAT

TABLE 28-continued

Genomic Repeats
(SEQ ID NO: 312)

```
30801  ATTTCATTGT ATATGTGTAT GCCACATTTT CTTTACCCAT TCATCCATTG

30851  AAGGTCATTT AGCTTGTTTC CATATCTTGG CTATTTTGAA TAGTGCTGCA

30901  ATGAACATAG GAGTGCAGAT ATCTCTTTAA GATACTGGTT TCATTTCTTT

30951  CTTTCTTCTC TTTTTTTTTT TTCTGAGACA GAGTCTGACT CTGTCGCTCA

31001  AGCTGGAGTA CAGTGGTGCA ATCTTGGCTC ACTGCAAACT CTGCCTCCTG

31051  AGTTCAAGCG ATTCTCGTGC CTCAACCTCC CAGGGAGTTT TGCTCTTGCT

31101  GCCCAGGCTG AAGTGCAGTG GTGCAATCTT CACTCACCAC AACCTGTGCC

31151  TCCCGGGTTC AAGCGATTCT CGTGCCTCAG CCTCCCAGGT AGCAAGGATT

31201  ACAGGCGCCC AACACCACAC CAGGCTAAAT TTTTTTGCAT TTTTAGTAGA

31251  GACGGGGTTT TGCCATGTTG GCCAGGCTGG TCTCAAATTC CTGGCCTCAA

31301  GTGATCCACC TGCCTCAGCC TCCTGAAGTG CTGGGATTTT ACAGGCATGA

31351  ACCACCACAC ATGGCCTCAT TTCTTTTAGA TATATATGGG TTGAGCTATT

31401  CTCAGAGGGT CCTTTTCTGC ATCTATTTAA GATCACATTT TTTTTATATT

31451  GTGGCAAAAA TACATGTAAC ATAAAATCTG CCATTTTAAC CATTTTTAAA

31501  TGTACAATTC AGTGACATTG ATTATATTCA CAATGTCATA CAGCCATCAC

31551  CACTATTTAT TTCTAATACT TTTCCATTGG GTAGATCCCC AACAGTGGGA

31601  TTGCTGGGTC AAATGGTAGT TCTGATTTTT TTTTTTTGTT TTTTGAGAAA

31651  TCTCCATACT GTTTTTCATT TGAGGTTGTA CTAATTTACA TTCCCACCAA

31701  CAGTGTATAA GAGTTTCCTA GGCCGGGCAT GGTGGCTTAT GCCTGTAATC

31751  CCAGCACTTT GCGAGGCCCA GGTGGGTGGA TCATGAGGTC AGGAGATCGA

31801  GACCACCCTG GCTAACATGG TGAAACCCCG TCTCTACTAA AAATGCAAAA

31851  AATTAGCCGG GCGTGGTGGC GGGTGCCTGT AGTCCCAGCT ACTGGAGAGG

31901  CTGAGGCAGG AGAATGGCAT GAACCCTGAA GGCGGGGCTT GCAGTGAGCT

31951  GAGATCGCAC CACTGCACAC TTCAACCTAG GCGACAGAGC GAGACTCCAT

32001  CTCAAAAAAA AAAAAAAAA AAAAGGTTTC CTTTCAGTGC ATCCTTGCCA

32051  ACTTGAGTTT TCTGGGTTGG TTTGCACTCT CATGGTATTT ACTAGATACT

32101  TCTCCATTTA TATTTTTACT CAACCCATGC CCATAACACC ACTCCTCTAC

32151  CATTCCCACC AACCATGTAT AAGAGTTCCT TTTCTTGCAT CCTTGCCAAC

32201  TTGACTTCTT TGGGTCAGTT TGCACTCTCT TGGTATTTAC TATTTACTTC

32251  TCCATTTATA TTTTTAGTCA ACTGATGCCC ATGGCACCGC TCCTCTGAGG

32301  CAGGTGCTGG GTACTAGAGT GATAAGACAG ATGCTGTCCC TGCCCTCACC

32351  CAGTGGAGAA GAACAGATGC TAAACAGGAA CATAAATATC TAAGTAAAAT

32401  GGCTTCAAAT GGAGTAAAGT GATATGAAAC ATAAATAAAT AGCAAGTGAT

32451  GGGTAGAGCA ACTTTACCCA GGATGAATCT TGGGCTGTGT CCCAAATGGC

32501  CATGAAAACT GTTCCAGGCA GGGAGAACAG CATGAGAAAA GGTCTTGAGG

32551  TGCAAATGAG CTTGGCATGT TCTATGAACA GCAAAGAGGC CAGTGTGGCT

32601  GGAGCAGAGA GAGAGCAAGA AGAAAAGAGA GAAAGGATGA GACTCAAGAC

32651  ATCAGCAAGT TTGAAGGGCC TTGGAGGACT TGGATTTTTT TTTTAAGAC
```

TABLE 28-continued

Genomic Repeats
(SEQ ID NO: 312)

```
32701 AGCTTTGTTC TTGTTGCCCA GGCATGATCT CGGCTCACCA CAACCTCCGC

32751 CTCCTGGGTT CAAACGATTC CTCTGCCTCA GCCTCCCGAG TAGCTGGGGG

32801 TAACAGGCAT GTGCCCACCA CACCTGGCTA ATTTTGTATT TTTAGTAGAA

32851 ATGGGGCTTC TCCATGGTTG GTCAGGCTGG TCTCGAACTC CCGACCTCAG

32901 GTGATCCGAC CGCCTCGGCC TCCCAAAGTG CTGGGATTAT AGGTGTGAGC

32951 CACTGCACCT GGCTTGGATT TTTTTTGTTC TATATTGTGG TAACATACAC

33001 ATCACATTAA ATTGATCATT TTAGCTATAT TTCCCGTTCA GTGGCATCAA

33051 GCACATTCAC ATTATTGTGC AACCATCACC ACTATCATCC ATCTCCAGAA

33101 CTTTCTCATC TTCCCAAACT GAAACTCCAT CCCCATGAAA CACTCATTCC

33151 TCATCCCCCT CCTCAAGCCT CTGGCACCCA CCATTCTACT TTCTGTCTCT

33201 GTGAATCTGA TGATTCTGAG GACCTCCTAT GAATGGAGGA ATCATATGGT

33251 ATATGTCCTG GTTTATACTG TATGGCTGGC TTATTTCACC AAGCATAATG

33301 TCCTCAAAGT TCATCCATGT TGTAGCATGT GTCAGAATTC CCTTCCTTTT

33351 CCACTTGTAT GTAAATGCTG TATTGTGTTT CTCCATTCAT TAGGACTTTG

33401 ATTTTTGCAG GGAGTTGTCA AGGGGTGCTG GGTTCTGGGG CTTCAATATA

33451 ATAAGAGTAA GCTAAACTGG TTCATTTCCT CCTTCGTGGA GACCATGTTC

33501 TGGTAGGAAC AGGAACAAAT AATTTATGAT TACATAGAGG GTGACCAGGG

33551 CAGTGACAGG GGAAGAGTGG AGGATTGTGG GACCCAGAGG AGGCTCCTGA

33601 CCTTGCCTAG GAAGATAGGA GGAGGAAGAG GAGGAGGAAG AGGAGGAGGA

33651 AGAGGAGGAG GAGGAGGAGG AGGGAGTCCT CTAAGCTGAG ACCTGGAGGA

33701 TGACCAGGAA GTTATCCAGG TAAGGAGAAA TGGGGAGAAG CTTCCAGACA

33751 AAAGTAACAG CAATTGCAAA GATCCTGAGA TGATAGATAA GGTCAGGTGG

33801 AGAAAGTGCA AACTGTCAAT GAGACCAAAA TATGGACTGT GAGTTGTGCA

33851 GTGACCACAA GTGGAGAGGT GCTAGGTGGC CTTCATCCCC CAAAGCTGCA
```

Exon R3
```
33901 CCTCTCCCTC CTCAGGTCTG TGAAGAACGG TGCTGAGACA CGGGTGGACC

33951 TCCTCTGCAC CTACCTGCAG CCCCTCAGCG GCCCAGGTCT GCCTATCAAG

34001 CAGGTGTTCC ATGAGCTGAG CCAGCAGACC CATGGCATCA CCCGGCTGGG

34051 CCCCTACTCT CTGGACAAAG ACAGCCTCTA CCTTAACGGT GAGCAGCTAT

34101 CAGCCCCATC TCCCTGCCCC ACCCCCAGC CCCCACTGCA GTCCAGGAGG

34151 GTGTCTGTTT GCCGGTTCTC TAGGGAAAGA CTTGGGGTTC AAGTCTTGGC

34201 ATTACCACTG GCCCTCCCAT AACCACAATG CAAGGTTGGA CTTTGATTAA

34251 TCCCATTTTA CAGATGAAGA AACTGAGGCT TAGACAGGCT AAGCAATTTA

34301 CCTTGACAGT GGTGGAACCA GGATATGAAC TCCACTTGTC AGCATTCGGT

34351 GCTATGATCC ACTCCACATG TTTAACTCAC AGAAGAGTCT TCCTGGTGGG

34401 GGCACTTGGG GGACAAAAAA CACATTTCCG GCTGTGAGCA GTGGCTCACA

34451 CCTGTAATCC CAGCACTTTG GGAGGCCAAG GCGGGCGGAT CACAAGGTCA

34501 AGAGATTGAG ACCACCCTGG ACAACATAGT GAAACCCTGT CTCTACTAAA

34551 AATACAAAAA TTAGCTGGGT GTGGTGGCGC ACGCCTGTAG TCCCACCTAC
```

TABLE 28-continued

Genomic Repeats
(SEQ ID NO: 312)

```
34601 TCGGGAGGCT GAGGCAGGAG AATCGCTTGA ACTCGGGAGG CAGAGGTTGC

34651 AGTGAGCCAA GATTGCGCCA TTGCACTCCA GTCTGGGTGA CAAGAGTGAA

34701 ACTCTGTCTC AAAAAAAAAA AAAACAATTT CCCCTCCCTG CTTTCTTCTC

34751 ACCATTGACG AGGGATGGGC TTCTCTCCTA CCTGAGGCCC CCTATACCAG

34801 GAAGATCTAT GGGATCTAAT CTTCAGCGCA CACTGGGCCT CAGCATTGGT

34851 CTAGAACTCA GGATAAGATA GCATTTAAGA AGGCATCCCC TAAATGGGGT

34901 TCTGAGAGGC AAAGCATGAC CGTGGAGAAT TGACAAAATA GCTCGCCTTT

34951 CATCCCCTCC ACCGCCAACC CAAGAACAGT GCTTATCATC ATGACCCCAT

35001 GAGGTGGGCA CCCCATATCA CTTATATGAG GTACCTTTAG GTAGGTACCG

35051 GGATGTGGAG AGACATCCTG GGCTTTCATT ACTCTTATTT TAGCAAAGAG

35101 GGAATCTGAG GCACAGAGAA GGGAAGGGAC TTGCCCATGC CCACAGCGAG

35151 TTTTTGGCTA GTATGGGTCT TGATGTTCTT TCTGGGTCCG TNNNNNNNNN

35201 NNNNNNNNNN NNNNNNNNNN NNNNNNNNNN NNNNNNNNNN NNNNNNNNNN

35251 NNNNNNNNNT TCCTGCGTGG GAGATGTGTG GATTTGATTT GTATCTGGAA

35301 AGATGATTTT TTATTGGTGA CAAAGCAGTT AAAGTTAATC TTCACAGTTG

35351 TGCGGAGAGT GACCACGCGA GTTAGTCTTA TCCTTATTTT TTTGATCATC

35401 CCGCTACACA AGACAAAGCG AACCGCACAG GCAACATCAG CAGGCCCCAT

35451 TGGTGTGTTC CCCTCTATGG GTCCATGTGT TCTCATCATT AGCTCCCACG

35501 TATAAAGTGA GAAGATGGCA GTATTGGTTT TCTGTTCCTG CATTAGTTTG

35551 GTAAGGATAA TGACCTCCAG CTCCAACCAT GTTCCTGCAA CGGACATGAT

35601 CTCATTCTTT TTTATAGCTG CATAGTATTC CATGGTGTAT ATGTTCCTCA

35651 TGTTCTTTAT CCAGTCTATC CTTGATGGGC ATTTAAGTAG ATTCCATGTC

35701 TTTGCTATTG TGAATAGTGC TTCAGTGAAC AGGTGTCTTT ATGATAGAAA

35751 AATTTATATG CCTTTGGGCA TATATGCAGT GATGAGATTG CTGGGTCAGA

35801 CGGTAGTTCT GTTTTTAGCT CTTTGAGGAA TCATCCTGCT GCTTTCTACA

35851 GTGGATGAAC TAATTTACAC TCCCACCAAC AGTGTATAAA CACTCCTTTT

35901 TATCTGCAAC CTCAGCAGCA TGGTTTTATT TCTCTTTATG GCTGAATAGT

35951 GTTCCATTGT GCATATATAC CACACTTTCT TTATGGATTC ATCTGCTGAT

36001 GGACATATAG GTTGATTCCA CATCTCTGCT ATTGTGAATA GTGCTGTGAT

36051 AAACACACAG GTGCGGGTTG GGTCTTGATG ATCTCAGTTA ACATCCAGTC

36101 CCTTCAACTT GGCTATTGCA GGGAGCTGTT CCCCCTTGTA AACTGCACAG

36151 CTTATGTGCT TCATTTTGTT CCTTCATTTA GATTTACCAA GCAGCTACTA

36201 TTAACCAGGC CACAATGTGC CTCGCCCCCA GGAACAGAGA TAGGTTACAT

36251 GTGCATCCTG TCCTAATGTA ATCTCCAGGG GGGCGGAGAC TGTTTTGTTC

36301 TACCCTATAT TCCCCAAATG TAAAGGGAGC CTTGCACATA CTAAGCCCTT

36351 AATAAACATT CATTGGGTGG AGGAATAGAT TGGAGGAGGC CTGGAAGGGG

36401 AGGCGGGGGT TATGGATGGA TAGGAGGATA GACTTGTGAA CACAAAGGTA

36451 GTGAGAGCCT CTCATTGGAG GCATGCTGGA GACGTGAGTA GGGAAGGGTC

36501 AGTGCTAATT GAAATATCAG GAAATTCTTT CTAGTGGTGA ACACATTTAA
```

TABLE 28-continued

Genomic Repeats
(SEQ ID NO: 312)

```
36551 GTCAAATATT AGATGATACA TAAATGTATC CATAATCTCT AGATACACAA

36601 AGGGAAAGGC ATCCAGGCAG GGGCCCCATA TGGACAAAGG CATGGAGTAT

36651 CTGGGACGGT TCCACCACCT CCTCTTACGT GTGACTTCTT TGTTTCAAGG

Exon R4
36701 TTACAATGAA CCTGGTCTAG ATGAGCCTCC TACAAGTACG TGTCTTTGAA

36751 TCTAGTGCCC ATTTCAATCT CCATGGGTCT TGGTTCAAGC TTTTCTCCTC

36801 ATTCATGAAG GAAGGTTGCC CCAAATTCGG GCTGGTCCCC TAGGTGGTGA

36851 GGGGCATTGT CTCAGTGGGA GGAAGAATGC TGAGTCCTTG GCCCTGTTTT

36901 TAGACCTGCA GCCATAGTCT TGGCTTTGTG AATTTTCCAT GTCCCTCTGG

36951 GTTGGAGGAA GAAGTTTGAA CAAGCATTCC CTACACGGGA TAGAGGTTGA

37001 GGTCAGATGA TGACCTCTGT TAGTCTGTAC CCTCCTTGAT AAGAAAATCT

37051 CCTCCAAGTG CCCCAGCAGA GGCTTCATGG TCAAGCTGCA GACTCTGCTG

37101 GCTACTGGTT TTGGCTAAAT TTGCCCATTG CCTCATCCAG TGATCCACTC

37151 GTCTATCTTT CCAGCCATCC ATTTTTCTAT CCTTCCAGTC ATCTCTCAGA

37201 CACCACCTGT CCTTCCATCC ATCCATCCGT CCATCCATTT ACCCATCCAT

37251 CCATCCACCC CATTTTCCTG ACCATTTACC TCCTCGTCCT TCCTTCCATC

37301 TGTCCTTTTA TCCATCTATT CATCCATCAC CCATCCTCCT GCCCATTCAC

37351 CTGCTTGTCC CTCCTTTCTT CTGTCCTTCT ATACATCCAT CCATCCATCC

37401 ATCCATCCAT CCACCCATCC ACTCATCCAC CACCCACCCA TCCTTCTGCC

37451 CACTCACTCG CTAGCCCCTC CTTCCTTCTG TCCTTCCATC CATCCATCCA

37501 CCCATCTTCC TGCCCATTCA CCTGCTTGTC CTTCCTTCTA TCTGTCTTTT

37551 ATCCATCTCT CCATCCATTC TCACCATCCA TCCATCCATC CTTCTCCCTA

37601 TTCACTGGTT TGTCTTTCCT TCTGTCCTTC CAACCATCCA CCCATCTCTC

37651 CATTCATTCT CCTCTTCATT CACCATGTTT CCTTATTTCT GTCTCTTCCA

37701 TCCATCCATC TATCCAGACA GACATCTCCT CCCCCCATTC TCCTCCCCAT

37751 TCACTCAATT GTCCTTCCTT CCATCTGTCC TTTTATCCAT CCATCCACCC

37801 ATCCATCCAT CCATCTATCC TTCTCCCCAT TCACCTGTTT GTCCTTCTTT

37851 CTGTCCTTCC AACCATCCAT CCATCCATCA TCCATCCATC TATCCTTTTC

37901 CCCATTCACC TGTTTTGTCC TTCCTTCTGT CCTTCCAACA TCCCTCCATC

37951 TCTCCATCCA TCCTCCTGCC TATTCATCTG CTTGTCTTTC CTTCCTTCTG

38001 TCCTTCCATC CATTCATCCA TCTGCCCATC CACCCACTCA TCCTCTTGCC

38051 CATTCACCTG CTTGTCCTTC CTTCCACCTG TCCTTTTATC CATCCATCCA

38101 TCCATCCATC TTGCTCACTC CTCCACTCAC ACAATCACTC CTTCCCTCAG

38151 TCTCATTTAT GGCCCACCTG TGAATGGTTG TCCTGGCTTG GACCACTGAT

38201 GAAGCCCAGG GGAGCTTCTC CCACTAGTGG TGGGCTTTTG TCCTCTCTGA

Exon R5
38251 TGGACTGTTC CTTCCACAGC TCCCAAGCCA GCCACCACAT TCCTGCCTCC

38301 TCTGTCAGAA GCCACAACAG GTATTTGGGG CCATTTTTCC TCCTCGAAGA

38351 TTAGAATAGC ATTTCAATCA GACACCTGCC CTCGTGGAGT CCCAGATTTT
```

TABLE 28-continued

Genomic Repeats
(SEQ ID NO: 312)

```
38401 ATGAAATAAA TAGACCATCA TAATGTCAGA TGTTTTGGGG TGAGATACCT

38451 GGCATAGTTG GGAAGGAGGA GGGCTTTCTG GAGAAAGTTT CACCTGAACT

38501 GAGTCTTTAA GGATGACTAA GAGTGATTCA GGCAAATAGG GCATGAATAG

38551 TATAACTGAA AGAGGGGAAT CTGTGAGCAA AGCCTCAGTG GCCAGAAACA

38601 GCATAGAGTA TAGGGAGAAG TGAGAGAAAT TTGGTTTGCA TGAAACATAA

38651 AGCTTAACCC AGAGTGGATG GATAAGTGAG ACTGAAAGGT CAGCAGGAGC

38701 CAGATTGGGA AGGGCCTTGA ATGCCAAGTC AAGAAATTTG AACTTAACAC

38751 TGAAGGCCAT AGGGAGCTGT GGATGGTACT AGAGCAGGGG CAGCCATAGT

38801 GAGATTGTCA TTTCAGAAAG ATTCTTCTTG TGTTCAGTAT AGAGAATGTC

38851 CTTTAGACAG GGCATCCAGT GAGTCTGCCA GGTGCTAATC AGGGTGAGAG

38901 AAAATAAGAC CTGAACTGGG ATAGGGGGAG GAGAGAGAGG ATATATGTGA

38951 TGAATATTCA GTAAAGAGAA TTGGTGTTAC TTGGAGGGGA GAAGACACAT

39001 AGCTTCTGAC TTGCGATGGC CACACTCAGT TTAATAATGA GCGCAGTCTG

39051 ATCTAGTCTC AGACCAGCCC TCAGTTGCAG ACGTCTCTCC TCCCCTCCTG
```

Exon R1
```
39101 CAGCATGGGG TACCACCTGA AGACCCTCAC ACTCAACTTC ACCATCTCCA

39151 ATCTCCAGTA TTCACCAGAT ATGGGCAAGG CTCAGCTAC ATTCAACTCC

39201 ACCGAGGGGG TCCTTCAGCA CCTGGTGAGA CCCTGGTCCC AGCAGCTCCT

39251 GGTGGGATAA ATCCTACCCC CAACCTCTGT TCCTCGGCTT ACCCTCTTCC
```

Exon R2
```
39301 TCCTTCCTCT CAAGCTCAGA CCCTTGTTCC AGAAGAGCAG CATGGGCCCC

39351 TTCTACTTGG GTTGCCAACT GATCTCCCTC AGGTGAGACC ACTTCCTGGC

39401 CATTTGCCAG TAACAACCAC CCCTTTTGTG ACCACCCCTT CCTCAGCTTT

39451 CCCCTGCTCC TCCCTCCACT GCTCTTTACC TGCAGAGGTC TCGGGACCTC
```

Exon R3
```
39501 TCTAGAGTCC TCAAATGCCT CTCTCCCCAG GCCTGAGAAG GATGGGGCAG

39551 CCACTGGTGT GGACACCACC TGCACCTACC ACCCTGACCC TGTGGGCCCC

39601 GGGCTGGACA TACAGCAGCT TTACTGGGAG CTGAGTCAGC TGACCCATGG

39651 TGTCACCCAA CTGGGCTTCT ATGTCCTGGA CAGGGATAGC CTCTTCATCA

39701 ATGGTGAGTG TCAGGCTGAA CTTGGATTTA CAGTGACTTT TGGGGAGTTG

39751 GTTTCTTTGT TTTTGAGATG GAGTCTCACT CTATCACCCA GGCTGGAGTG

39801 CAATGGTGCA ATCTTGGCTC TGCAACAGTG ATTCTCCTGC CTCAGCCTCC

39851 CAAGTAGCTG GGATTTACAG GTGCATGCCA CCACGCTCAG CTAATTTTTG

39901 TATTTTTAGT AGAGATGGGG TTTCACCATG TTGCCCAGGC TGGTCTCGAA

39951 CTCCTGACCT CAGGTGATCC ACCTGCCTTG GCCTCCCAAA GTGCCAGGAT

40001 TACAGGCATG AGCCACCATG CCCGGCCCAC CATGACTATT ATTTGTCCCT

40051 GTTGTATGCC CTTTCCTCTC TAAAAAAAAT AGCCCAAGGC CTGGCTGGGG

40101 GACACCCTTC CCCAAACCAC CAAGGGGAGG GTCTTTCCCA TTATTTTGAG

40151 TAAATAGCAT GAAATTCTTT GACCAAATTA ATGTCATAAA TTGTTTGTCT

40201 CTTTCTCCTT CACTTTTGTT TCCAACTTGG TTGCGGTATA ACTATCAAAT
```

TABLE 28-continued

Genomic Repeats
(SEQ ID NO: 312)

```
40251  ACAATTGTAT GTATTTAAGA TGTATAATGC AGTGATTTAA TATATGTGTA

40301  GCTTATGAAA TGATTACCAT GATCAAATTA GTTAACACTG CTTTCATGTC

40351  ACATAGTTAC CGTGTGTCTG TGTGCGTCTG TGTGAGTTAG AGAGAAAGAG

40401  AACATTTAAG GTCTACCCTC ATAGAAAATT TCAGGTTTAC AATACAGTAT

40451  TATTAACTAT AATCATCAAG CTTTATACTC GATCCCCAGA ACTTATTCAT

40501  CTTGTAACTA AAAGTTTGTA TTTTGTGACC AACATCTCCC CATTTTCTCT

40551  ATCACCACCC CCATGCCCCC AGCCCCTGAT AACCATCATG CTACTCTCTG

40601  CTTCTGTAAG TTTGACTTCT GATCCCACAT ATAAGTGAGA TCATGCAGTA

40651  TTTGTTTCTC TCTATCTGGT ATATTTCACT TAGCATAATG AACCCCCCCC

40701  AGGTACATCC ATAATGAATT TCAATTCAAA ACCCAAGTGG CTGAGTCGTG

40751  GCATCCTTTG GGACAGGATA GCAGGTCCCT TCTATATAAG GATCCTCTGT

40801  GTCAGTGGTT ATTACCAGGG GACAATTCTG CACTTCTGCC CCACCCCACC

40851  CCCCAACTGG GAGACTCTAG GCAATATCCG AAATCATTTT TGGGTATCAC

40901  AACTCAGGGA GGGAAGGAGG GTGCAACTGG CACCTAGTGG GTCGGTAGCC

40951  CATTTTCCAG TGCACAGGAG ACAACCACCC CAGGGAATGA TCCAGCCCCA

41001  AATGCCAATA ATTTCAAGGG TGAGAAATCC TGTTGTACAT GGTCTCAAAG

41051  TTCTTAGGTG GGCACAAGGC TGACATTTAT CACACTTTAC TGTAATTACT

41101  TGTTAAATTT ATCTGATTCC CCCTTACCCT GTGAACTCAA CAAAATTACG

41151  GTCTATTATG AGTGCCACTG TACCCTCGGT TCGCAGTACA TCAGCACATC

41201  ATAGTATGGA AAGAATCATT GAATGAGTGA GCAAATTAAA GATTTGTGTC

41251  TCTGCTGTAA CTCACATTCA TTAATTCATT CATTCAGCAA ACATATATGG

41301  GTGGCTGTTC TGCCCCAAGC CTTGTACTGG GTCTGGAGAT AGAAGACACA

41351  TTTTTCTGTC TCTGAAAAAC TCATACTCAA GTTAACAACA AATTACGGGC

41401  ACAACAAAGA CCCCACTGCT GTTATTAACA GGGTACTATG GGAGCTGAGA

41451  GGAGGAGTAA ATTAAGGAGG GCTTCCTGGA GGAGGGTGTT ATATACCCGG

41501  CCCTGTGCCG GGACACATAA TGATAAGACA GACTTGGGCC TCTGCTGTCC

41551  TGGAGCTCCC TCTCACTGGG CTCTTGAAGC GTGAGCAGGA GTTTTGCAGG

41601  AAATGAAAAG GATGCATTCC TAGAAGTGGG AACTGCATAG CACATGCAGG

41651  AAAGCTCAGC TCAGAAGAAT CTGTGTAATA TTCCATTTTT CCCTCTCTTT

41701  GGGGCAACTT TCTGTCTAAG AGCTCCTGCA ATGCCCAGCG TGTGGACCTG

41751  AAATTGATTC TGACAGTAGG CAGGGGACTG CTGGGCAACT TTGGCTCTGC

41801  ATTTTGTGAT CAACATTTCC CCACCATATG TTGCCTTTTC TTCTTCTCTG
```

Exon R4
```
41851  TGGCTCCAGG CTATGCACCC CAGAATTTAT CAATCCGGGG CGAGTACCAG

41901  ATAAATTTCC ACATTGTCAA CTGGAACCTC AGTAATCCAG ACCCCACATC

41951  CTCAGAGTAC ATCACCCTGC TGAGGGACAT CCAGGACAAG GTGGGGCATC

42001  TCTCACCCCT CCCGTCTTCT CTGTCCTGTG TGCTTCTCTC CCTCTTCTAC

42051  CTGATTTCTC TGTTAAGTGA TCACTTTAAA TGCTTCACTT CACTATGTAT

42101  TCTGGGTTCT CTCTCAGTTT CCAAAAGTAC TCTCTTGACT ACCATTCCCA
```

TABLE 28-continued

Genomic Repeats
(SEQ ID NO: 312)

| | |
|---|---|
| 42151 | TTTCACAGAT GGGCAAACTG AGGCTCAGAA AGGGGCGTGG TGTGCCTAGG |
| 42201 | GTCATACAGT GCTTTAGGAA CAGAGTTAGG ATTTGAACTC TGGTCCCCTT |
| 42251 | TGCTCCAAGT CCTGTGTTTT TTTCCACTGG CATCAGCGGC CCCTCCACCC |
| 42301 | CCAAGAGGCC TCCATCTCAC CCACTCTCCC TACCCATCTT TCTAGGTC |

TABLE 29

Genomic Carboxy Terminal
(SEQ ID NO: 313)

Exon C1

| | |
|---|---|
| 1 | ACCACACTCT ACAAAGGCAG TCAACTACAT GACACATTCC GCTTCTGCCT |
| 51 | GGTCACCAAC TTGACGTAAG TTCTGAAGGT CATAAGCAGT GACCAAGCTT |
| 101 | GTGGCTGTGT CTCTGAGCAC CCTTGAGCTA GACGTCCCCA GTGGGGTACC |
| 151 | CATTCTCCCC TACATCCCTG TCTAGCTAAT CCTACCATCT CCTCCCATAA |
| 201 | ATCCTCAAGG TAGGGAGTGA GGATTAACCT CATGGGGCCA CCAACTCCCA |
| 251 | GCATACACCT TCTTTTTTTT CTGGACACTT GGGAAAATAT AACTTTTTGA |
| 301 | TGTAGAACTC AAAATATTAG CCCAATAATA ATATTTAACA TCAACCAGCC |
| 351 | TCCTCTCATT TAATTCTCAC AACAGAATCT ATGAGTTGAG TGCAAAAATC |
| 401 | ATCCCTATTG TGCAGATGGG AAAACTGAGG GTCAGAAAAG TGAACTTCCC |
| 451 | AAGAACTGTC AAAGTTGGGA TTTGAACCCA GGTCTCTGAT GACTGGATGA |
| 501 | AGGAATGAAG ATACCTATAC TTGGGAATGA GGAGGGTCGA CAGGACACGA |
| 551 | GGGCTGACTT TGTATATTTC TAAACTTCAA AGATTTTCTG TATTTCAGCT |
| 601 | GGGAATATGG TAGAAGGTTA ATTGGAACAA AAAAATGCAA AGCAATGAAT |
| 651 | AAGACCTCAG TATTTGCTAT GCACAACAGG GTGACTGTAG TCCCACAAAT |
| 701 | AACTTCACTG TACATTGTTA AAATATAACT AAAGGTGTAT GCTTGGATTG |
| 751 | TTTGCAACAC AAAGGATATA TGCTTGAGGG GATGGATACC CCATTTACCC |
| 801 | TGATGATTAT TATGCATTAC ATGCTTGTAT CAAAACATCT CATATACCCC |
| 851 | ATAAATATAA AAACACCTAC TATGTACCCC AAAAAATTAA AACAAATAA |
| 1051 | AGGCATGGTG GCACACACCT GTAGTCCCAG CCACTCAGGA AGCTGAGGTG |
| 1101 | GGAGGATCGC CTGAGCCTAG GAGGCTGTAC TCCAGCCTGG GTGACAGAGC |
| 1151 | GAGACTCTAT CTCAAAAAAT AAATAAAAT AATAAAAAGT AGAAATCAAG |
| 1201 | AGGGAAAATG TGGGAGAAAT TGGGATAATT TTAACAATAC CTTCCACCAG |
| 1251 | AGTGATGATG AAGAATGCAT AAGTCACTTC TTAGTGGTCT TGATCTATAA |
| 1301 | AAAGTGTTCA ATAAATATCG ATTATTGTTA CTGTTATTGC TTCTAGACGT |
| 1351 | AATTCCTGGA AGCATTTTTT TTTTTTTTT TTTTGAGATG GAGTCATGCT |
| 1401 | CTGTTGCTCA GGCTGGAGTG CAGTGGTATG ATCTCGGCTC ACTACAACTG |
| 1451 | CCTCCTGGGT TCAAGCAATT CTCCTGCCTC AGCCCCCCAT GTAGCAGGGA |
| 1501 | CTACAGGCAT GCGCCACCAC ACCCGGTGAA GTTTTGTATT TTATTAGAG |
| 1551 | ACAGGGTTTT GCCATGTTGG TCAGGCTGGT CTCGAACTCC TGACCTCAGG |
| 1601 | CAATTTGCCT GCCTCGGCCT CCCAAAGTGC TGAGATTACA GGCTTGGGCC |

TABLE 29-continued

Genomic Carboxy Terminal
(SEQ ID NO: 313)

```
1651 ACTGCATCCA GCCGAAGGCC TCCCATTTTG ATCAGAACCC TTCTCTAGAC
1701 TGAGGGTGGG TGCCTCTAGA TCTTTTGCTC TTTAAAGACA GCAACCGATG
1751 ACCCTGCTGA TGCTGAGTAC TGGCTGAATT CCTGTGGTCT CTGTCCCTAG
```

Exon C2

```
1801 GATGGACTCC GTGTTGGTCA CTGTCAAGGC ATTGTTCTCC TCCAATTTGG
1851 ACCCCAGCCT GGTGGAGCAA GTCTTTCTAG ATAAGACCCT GAATGCCTCA
1901 TTCCATTGGC TGGGCTCCAC CTACCAGTTG GTGGACATCC ATGTGACAGG
1951 TACAAGGTGG GGTGGCTGGT TTCCTAACTG GAAGAGGTGG GGTTATGAGG
2001 AAAGATGGGG CTTCTCGGTA CCAGTGGAAT TGGTGGAGGC TCTAGAGAGG
2051 GAAAGGGAGG CTTTCTGGAG ACCCATGTAG GTGACCTCTG GCAGTAGATC
2101 ATCCAACGAG GCAGGAACAG AACACCAGCC ATTGCATCTA AGAGAATAGC
2151 TATTTTTACA TGTAAAAAGA ATTGTGTTGA ATGAATGAAT CAATAGATCA
2201 TTTATTTTGA ATCAATTTAT TGATTCATTC ATTTAATTAA TGAATAATAA
2251 ATGATTCAGT ACATAATTGA TTAATTGATG TAATTGAGAA TTGATTTAAT
2301 TGATTAATTG ATCAATTAAA ATGATCAATT AAATGAATGA ATCAGTAAAT
2351 GAATAATTCA TTCATTCAAT AAACAATGGA AGTAGGCCGG GCATGGTGGC
2401 TCACGCCTGT AATACCAGTA CTTTGGGAGG CCCAGGCAGG CAGATCACGA
2451 GGTCAGGAGA TTGAGACCAT CCTGGCTAAC ACGGTGAAAC CCTGTCTCTA
2501 CTAAAAATAC AAAAAAAATT AGCCAGGCAT GGTGGTGGCC ACCTGTAGTC
2551 GCAGCTACTC GGGAGGCTGA GGCAGGAGAA TGGCGTGAAC CCGGGAGGCA
2601 GAGCTTGCAG TGAGCCGAGA TCGCGCCACT GCACTCCAGC CTGGGCGACA
2651 GATGGAGACT CTGTCTCAAA ATAAATAAA TAAATAAAAA TAAAAAATAA
2701 ATAAACAATG GAAGTAAACA CGTACTGATA ACACAGTGTG ATCATTGCTA
2751 TGATAAGGGA ATTTCAGGGG CCTGTGGGAG CCCCAAGGAG GAACACACAA
2801 CCTTGTCTTG GAAAGTTTTA TGTAGGAAGG GGTGAAGAAG CTGAGATCTG
2851 ACAGAGAATG GGACCTAGCC AGGGGTAATA GATGGAGAAT TGTGCTCCAT
2901 GCATCTATAA CCTAGAAGAT AGAAAGAATA TGGCATCTGG CCGGGTGCGG
2951 TGGCTCACGC CTGTAGTCCC AGCACTTTCA GAGGCTGAGA TGGGTGGATC
3001 ACCTGAGGTC AGGAGTTCAA GACCAGCCTG ACCAATATGA TGAAACCCCA
3051 TCTCTGCTAA AAATACAAAA ATTAGCCAGG CATGGTGGTG CGTGCCTGTA
3101 ATCCCAGCCA CTTGGGAGGC TGAGAGAGGA GAACTGCTTG AACTCGGGAG
3151 GCGGAGGTTG CAGTGAGCCG AGATTGTGCC ATTGCACTCA AGCCTGGGCA
3201 AAAAGAGCAA AACTGCATTT CAAAAAAAAA AAAAGTGGCA TTTTGGGGCA
3251 AGTTTAAGAA GATTGGTGTA GCTGGAGCAT CCACTTTGAT ACTGGAGAGG
3301 TGACAGTTGA AGCCAAAGAT GTGGGCAGAG ACTTTGTTGG CACTGGAAT
3351 GGCTTGGGGA GGAACATGAC ACACTCATGA GTTCTGCTTT AGAAAGAAAA
3401 TGAAATGAAT TCTGCTCATC CTCTGGGTGC TGTGTGCAGA ATGGAGGGTG
3451 GGGGGAGAGA AGAGCAAAGG CAAGAAGACC CTTTAGGAAC AATGATCATT
```

TABLE 29-continued

Genomic Carboxy Terminal
(SEQ ID NO: 313)

```
3501 AGTTAGAAGA CTCTGGGTTT CTCAGCACCT GCAATTGCTG ACTACACCCC
3551 CAGAGAAACC CAGTCTCTTT TCCCCCATGT TGTAGAGAAT TCTTACAATG
3601 CTTGGTAGAA AGAGAATTGA ACAGGTAGAT GGGTGGATGG ATACAAGCTG
3651 GACAGATGGA TGGAGGAAGA TCCTCCATCC AATATAGAGC TGTTACCTAA
3701 AACCCTCCAT CCCACCTTTA AAATCCTAGC TCAGCCAGGC GCGGTGGCTC
3751 ACACCTGTAA TCCCAGCACT TTGGGAGGCC AAGGCGGGTG GATCACTTGA
3801 GGTCGGGGGT TCGAGACCAG TCTGACCAAC ATGGTGAAAC CCCCTTCTCC
3851 ACTAAAAATA CAAAAAAAAA AAAAGTTAG CCAGGCAGGG TGGCGCATGC
3901 CTGTAATCCC GCTACTCGGG AGGCTGAGGC AGGAGAATGG CTTGCACCCA
3951 GGAGGTGGAG GTTGTGGTGA GCCAAGATCA CGCCATTACA CTCCAGCCTG
4001 GGCAAAGAGA GTGAAACTGT CTCAAAAAAC AAAACAAATG ACCCCCCTGC
4051 CAAAAAAAAA AAAAAAAAA AAGAAAAGAA AAAAGAAAA GCCTAGCTCA
4101 GCTCACACTG TCAGGAATAA GTAAGCTAGC TGGAATCATC TCTTTCTTAA
```

Exon C3

```
4151 AACCCTGCCT TGATAGTGGA TTTTTACATA CTTTTTTTTT AATTCTAGAA
4201 ATGGAGTCAT CAGTTTATCA ACCAACAAGC AGCTCCAGCA CCCAGCACTT
4251 CTACCTGAAT TTCACCATCA CCAACCTACC ATATTCCCAG GACAAAGCCC
4301 AGCCAGGCAC CACCAATTAC CAGAGGAACA AAAGGAATAT TGAGGATGCG
4351 GTGAGAAGGG GGTGGTATGT CCACTCTGTT GCCATGCAGA AACTGACTTA
4401 TGCATACTGG GTAGCCACAG GGTGACTTTT TATAACAATC CACAAAGACA
4451 GGTTCTTATT CCCATTTAAT ACACAAGCAC AGAGAGGTTC AGTAGCTGAC
4501 CCAAGGTCAC ACAGCTAAGT CATACCCTAG AAGAGCATGT CCTTTGATAT
4551 ACATACCTGG GCAAGTGGTT GTCATGACAA GAAGCAAAAT AGACGGAGAA
4601 GTGTGCTCAG TGGCTGAAAA TTCTCTGATG CTACTGGGGC CAGGATTCTG
```

Exon C4

```
4651 ACCTAAGAAA CATCGCCCTG TCTTTCAGCT CAACCAACTC TTCCGAAACA
4701 GCAGCATCAA GAGTTATTTT TCTGACTGTC AAGTTTCAAC ATTCAGGTAA
4751 GTTCTAACTC AGGACCTAAT GACTCTAGGA ACTTCTGCTG TCCTTTAAAT
4801 AGAAGTGTCC CCAAGCCATA GCTTTGATGG AAGAGAGCCC TAGAAATAGA
4851 GAGCTGTTAA CTAAAAACTA GCTTTTTCCT AAAGCTGGAG CCCAACTGGC
4901 TTCAACACTC AAGAGAGCTG GTGTAAATCT CAGCAGACAT AAAGGTACCT
4951 GGTGCTGAGG CCATGGAGTC TAGAGTGTAG AATCTACTAC ATTAAGACAT
5001 CAGCTACTGA AATCAGGACC CATGGAAGAC GGGGAAGGA GGGGACTAAA
5051 ACCAGATTAC TTAGAATCTA GCAGCCTAAC TGTGCTTTTC AATGAGAGGT
5101 ATCATTTCCA ATGGTGGGGG GTACCAATGA TTTTTTTTTT TTGACAACTG
5151 CCTTGAGAAC AGGCTTTCCT CACTAAACAA ATTCTGAATC AGAACAAATA
5201 AAGATAAGCC CTGAGAATAG GGCTTTTTCA AGGAGCTGCC AAACAGATCA
5251 AATAGTGACT ATGTTCTGCA GATTGATGTC TGGAGAACTC TACAGCTATT
5301 TTGACTGCTA GGCAGCTGGT TTTCACAGAT ATCATGATTC TGAGGCTGCC
```

TABLE 29-continued

Genomic Carboxy Terminal
(SEQ ID NO: 313)

```
5351 AGTTTTCAAA GTTACCGAGG ATCTTGCTGG ATGCAGTGGC TTGCGACTGT

5401 AATCCCAGCC CTTTGGGAGG CCAAGGTGGG TAGATCGCTT GAGCTCAGGA

5451 GTTTGAGACC AGCCTGGGCA ATATGGTGAA ACCCATCTC TACAAAAAAT

5501 ACAAAAATCA GCTGAGCATA GTGGCATGTG CTGTAGTCCC AGTTACTTAG

5551 GAGGCTGAGG TGGGAGGATG GCTTGAGCCC AGGAGGCAGA GGTTGCAGTG

5601 AGCTGACATT GTGCCATGCA CTCTAGCCTG GGCAACAGAG CCAAAGCCTG

5651 TCTCAAAAAA AAAAAAACAA ATAATAATAA TAATAAAATA CTGAGGATCT

5701 TGAAAGAGCA CTGTGGAAAT AATGCAAGTT AAAATGCCAC AAAGCTTGCT

5751 CTTTTTACTG AGATTTAACA CTTTCCTTAA CTAAACACCC CTCGAATTTT

5801 TGCAAGCCTT TGGTTCACTT CTAGACTTCT GGAAAAATTG ATTTGGACTA

5851 TTTTGGCCAA TGTTCTCATT GATTTTATGG GTATTCAGAA GTTGTTACCC

5901 CAACATTCCA GAAATGTTCT CCCTGTGGCT ATTACTTTAT TTATTTATTT

5951 ATTTATTTAT TTATTTATTT ATTTGAGACG GAGTCTCCCT CTGTTGCCCA

6001 GGCTGGAGTG CAGTGGCGCA ATCTCAGCTC ACTGCAACCT CCGCTTCCCA

6051 GGTTCAAGCG ATTCTCCTGC CTCAGCCTCC CAAGTAGCTG GGATTATGGA

6101 TGTGCACCAC CACACCGGCT AATTTTTGTG TTTTTAGTAG AGATGGGGTT

6151 TCACTGTGTT GGCCAGGCTG GTCTCGAACT CCTGATCTCA AGTGATCCAC

6201 CCGCCTTGGC CTCCCAAAGT GCTGGGATAA CAGGCATGAG CCACTGTGCC

6251 TGACCTCCCT GTGGCTATTT TTAAATGAAT TAAGTGGAAT AAAATTAGAA

6301 ATTCAGTTCT TCTCCCACGC TAGCTGCATT TTAAGCATTT AATAACAACA

6351 TGAAGCTACT AATGGCTGCA TTGTGTAGTG CAGATGTAGA ATTTTTTTTT

6401 TGTTTTTTGT TTTGTTTTTG AGATGGAGTC TCGCTCTGTC ACCAGGCTAG

6451 AGTGCAGTGG CGTGATCTCG TCTCACTGCA ATCTCTACTC CCCGATTCAA

6501 GTGATTCTCC TGCCTCAGCC TCCCAAGTAG CTGGGATTAC AGGCACGTGC

6551 CACCACACCC AGCTAATATT TGTATGGATG GTCTCAATCT CCTGACCTCG

6601 TGATTTGTAT GGATGGTCTC GATCTGACCT CATGATCCGC CTGCCTGGGC

6651 CTCCCAAAGT GCTGGGATTA CAGGCGTGAG CCACTGTGCC CGGCCGACAT

6701 AGAATGTTTA CATCATTGCA GAAAGTTTCT GCAGGAAGAG CCTAGAAGGA

6751 GAAAGCCTAG AATCATGATA AAATTGCAGA TATCTTTGCT TATCCCTGTC
```

Exon C5

```
6801 CCCTTCCAGG TCTGTCCCCA ACAGGCACCA CACCGGGGTG GACTCCCTGT

6851 GTAACTTCTC GCCACTGGCT CGGAGAGTAG ACAGAGTTGC CATCTATGAG

6901 GAATTTCTGC GGATGACCCG GAATGGTACC CAGCTGCAGA ACTTCACCCT

6951 GGACAGGAGC AGTGTCCTTG TGGATGGTAA AGCTCCCTGG GTCATTGGGA

7001 CTGAGGTGGA AGCTCCCACT TCCTCACCTG GGTCCTTCCC TGGGAATCTG

7051 AAGGCTTGGG GTTGATTCGT CATCGAGCTT TCTCAGACTG GGAGAAAGTG

7101 GCTTAGTTCT CCTAAGCTTT ACCCATCATT GAAGGAAAGA AAAGGACGCC

7151 CGAGGGATAT GGGAGGCATT TGCCCTCTTC TGGCCAGCTC TGTGACCTCA
```

TABLE 29-continued

Genomic Carboxy Terminal
(SEQ ID NO: 313)

```
7201 GGCTAGTCAC ATCTCCTTTC TGGACTTCTT ATCTCTCTGT ACTTAGCAAG

7251 CCACTTGGTT TTTGGTTCCC ATCTTGCCTG CCCTAGATGG TATTGCTCCT

7301 CCACCCCCAG GCAGCTGCAG TGTTAAACAA TTACCCTGAT TAGTTATTGT

7351 TGTTGTGTTG TTTGTTTGTT TTTGAGACAG GGTCTCACTC TGTCACCTAG

7401 GCTGGAGTGC AGTGACATGA TCTCAGCTCA CTGCAACCTC AACCCCTGGA

7451 CTCAAGCAAT CCACCCACTT CAGCCTCCCA AGTAACTGGG ACTACAGCCA

7501 TGCGCCACCA CACCCGGATA ATTTTTGTAT TTTTTCTAGA GATGGGGTTT

7551 TGCAACATTG CCCAGGCTGG TCTTGAACTC CTGAGCTCAA GCATGCCACC

7601 TGCTTCAGCC TCCCAAAGTG CTGGGATTAC AGGCAGGCAG GCACCACTGC

7651 AGCTGGTTCT GGTTTTTTGT GTTTGTTTTT TTCTTTTAGA GGCAGGGTCT

7701 CGCTCTGTTA ACCAGAATGG AGTACAGTGG TGCAATCATA GCTCACTGCA

7751 GTCTTGAACT CCTGGGCTCA AGCGATCCTC CCACCTCAGC CTCCTGAGTA

7801 CCTGGAACTA CAGGCACGTG TCACCACGCC TTGCTAATTT CTAAATTTTT

7851 TGTAGAGACA GGGTCTCACT ATGTTGCCCA GACTGGTCTC TAATTCCTGG

7901 CCACAAGTGA TCCTCCTGCC TCAGCAGGTC AATGAGGGCT TCCAGTTTCA

7951 AGTTGTATGT GATTCATCCT CAACAAATGT GGTAGGATGG ACCTATTTTC

8001 CAACTCCAGA GATGGCTTCA AGGTGGCTCA ACTTTGCATA TCCAATTTTA

8051 CCCATTCAAA GAATAGTTAT ATACATTGTA CCATGTATCA GGAATATAAC

8101 AGAGAGTAAC TGTTTGCTCT TTCACCACTA TATTCCAAGA ACCCCATATT

8151 CTGCCTGGCA CATAATAAAC ACTCAAGTCA TATTTGCAGA AGGAATAACT

8201 AGATTTCATA CAAGGTTCTT TTCAAGTCAA ATGCGAATAA CGTTTTAGAC

8251 GGGACCTTCC AATGCCTGTG TGCACTGTCC TTGATTCCGA ATTATTGTTG

8301 TGCAAGAGAG CACTGTTGAT CCTTCAGAAT CAACAAGCCT TTCACATGCC

8351 TGTCACAGGT TTTTCTTTTT CTTGTTTTAC CAATTTTGTT TGTTGTTTGT

8401 TTGTTGTTAT TGTTTTGTTT TGTTTTTGTT TTTTATTTGT TTTTATTTTT

8451 TCTTTTTTTT TGAGACAGAG TCTCGCTCTG TCACCCAGGC TGGAGTGCAG

8501 TGGCACGATC TCCGCCCACT GCAAGCTCCG CCTCCTGGGT TCATGCCATT

8551 TTCCTGCCTC AGCCTCCTGA GTAGCTGGGA CTACAGGCGC CTGCCACCAT

8601 GTCTGGCTAA TTTTTTTTGT ATTTTTAGTA GAAACAGGGT TTCACCATGT

8651 TGACCAGGAT GGTCTCGATC TCCTGACCTC GTGATCTGCC CACCTGGGCC

8701 TCCCAAAGTG CTGGGATTAC AGGCGTGAGC CACCACACCC AGCCCCAATT

8751 TTTTTTTTAA TTAAAATTGT TGTCAGCTCA CAAGCTTTCT AAAAACAGGC

8801 CATGGACCCA GCATCGCTGT AGTTTGCCAA ACCCTTGCCT TGAATCAGTA

8851 CCATCCAATA GAACTTTCTG CAGTGATAGA AAATGTTTCT ATCTGTGCTA

8901 TTCAGCACAA AGCCATGTGT GATTACTAAG CTTGAAGTGT GGTTAATGTA

8951 ACTGAGATAC CGAAGTTTTA ATTTTATTTA ATTTTAATTT AAAAAGCCAC

9001 TTGTGGCTGC TCCATATTGC ACACTACTTT TTAAAATTAT TATTTGTATA

9051 TATTTAAGGG GCACAAGTAC AATTTTGTTG CATGGATTTA TAGCCCAGTG

9101 GGGAAGTCTG GGCTTTTAGG GTATCTATTA CCTGAATAAT GTACATTGTA
```

TABLE 29-continued

Genomic Carboxy Terminal
(SEQ ID NO: 313)

```
9151 CCCATTGAGT AATTTCTCAT CATCCACTCT CCTCCACTCC CCAACCCTTC

9201 CAAGTTTCCA CTGTCTATTA TTCCACTCTC TATGTCCATG CCTATGCATT

9251 ATTTAGCATT GACATGTCTA TGCATTATTT AGTCAAATAC ATGTGCTATT

9301 TGACTTCCTG TATCTGAGTT GTTTGACTTA AGATAATGAC CTTCACTTGC

9351 ATCCATGTTG CTGCAAAAGA CATGATTTCA TTCTTTTTTA TGCCTGGGTG

9401 GTATTGCATT GTGTGTGTGT GTGTGTGTGT GTGTGTAGAG AGAGAGAGAG

9451 ATCACATTTT CTTTATACAG TCCTCCATTG ATGGGCACTT AGGTTGATTC

9501 CATATCTTTG CTATTGTGAA TAGTTTTGTG ATAAACACAC AGGTTCAGGT

9551 GTCTTTTTGA CAAAATTATT TATTTTCCTT TGTGTAGATA CCCAGTCGTG

9601 GGATTCCTGG ATCAAATGGT AGTTTCATTT TTAGTTATTT GAGAAATCTC

9651 CACGTTTTTC ATAGAGATTA TACTAAATTA CATTCCCACC AACAGTGTGT

9701 AACGGTTCAC TTTTCTTGCA TCCTTTTTAA CATCTGTTAT TTTTGTCTTT

9751 TTAGTAACAG CCATTCTGAC TGGCGTAAGG TGGTATCTCA TCATGGTTTT

9801 AATCTGTATT TCTCTGATTA TTAGTAATGT CGAGCATTTT TTCATATGCT

9851 TGTTAGCCAT TGGTATGTCT TCTACATCTT TAAGAAGCTG GCTATGGGCT

9901 GGGCGCAGTG GCTCACACCT GTAATCCCAG CACTTTGGGA GGCCGAGGCA

9951 GGCGGATCAC GAGGTCAGGA GTTAAAAACC AGCCTGGCCA ACATGGTAAA

10001 ACCCTGCCTC TACTAAAAAT ACAAAAAATT ACCCAGGCAT GGTGGTGCGC

10051 CTGTAATCCC AGCTACTCAG GAAGCTGAGG CAGGAGAATC ACTTGAACCC

10101 AGGAGGCGGA GGTTGCAGTG AGACGAGATC ACATCATTGC ACTCCAGCCT

10151 GGGTGACAGA GTGAGACTCT ATCTTGAGAA AAAAAAAAG TTGGCTATAA

10201 CAGGGTTGTA GAAGTAGAGG AACCAGTAAC CCTTCTCGCC ATGCCTGATG

10251 ATGGCTTTAC ATCCCTGTCT TCATGGAGTT TATGCTGTCG TGAGGAATAA

10301 CAAGAACAGG CAGTTGTCAA TTATAAATTA TTTGATGTGA ACCTATTCAT

10351 ACATGGGTGT GGTCATCAGG GAAGGCTTCC TGGAGGAAAT GACATTGAAG

10401 GTGAATTCTA AAAGATGACG ATAAACCACC AAGTGAAGGA GAGCTTAAAT

10451 GTGTTTTTAG GCAGAAGAAA AACCTTTTGG GTGAAAATTT TAAAACTTAG

10501 AGAGGTCCCA TCAGTTTCCA ACTGCGATGA TCCATTCTCT CCACCACTGC

10551 CCTTGGGCCC AGCCCAATTT AGGTCCACCA TGCCCAGAGG CATGAATTTA

10601 ACTTATGACA CTCTTGTGGT GGAATAATGG CTTTGGGCTT ATGTAGCCAT

10651 GTGTCATTTT TTTAGAGATA CAAATTGAAA TATTTGGGGT GAGATGTCAT

10701 GGTGTCTACT GGCCTCTAAA ACTTCAGTGA AAACATTTAC TTTCACTGAA

10751 ATGTCAATAA ATCATAAATT GGATGTATAT GTTTTAGTTG GAGGAAATAT

10801 AAACCACTAA ATCTAGGTGA TGCATATTTA TTATACTCTT CTCTCTGCTT

10851 TTTTGTACGC TTGTAAAATT GTATTTAAAA GAATAAGACA CACTTGGCCG

10901 GGCGCGGTGG CTCACGCCTG TAATCCCAGC ACTTTGGGAG ACCGAGGTGG

10951 GTGGATCATG AGGTCAGGAG TTCAAGACCA GCCTGGCCAA CATGGTAAAA

11001 CTCCATCACT ACATACAAAA ATTAGCCAGG CATTTGGCG GGCACCTGTA
```

TABLE 29-continued

Genomic Carboxy Terminal
(SEQ ID NO: 313)

11051 ATCTCAGCTA CTTGGGAGGC TGAAGCAGGA GAATTGCTTG AACCCGGGAA

11101 GCAGAGGTTG CAGTGAGCCA AGATCACGCC ACTGCACTCT AGCCTGGGCA

11151 ACAGAGCAAG ACTCCATCTC CAGAAAAAAA AAAAAAAAAA GACACACTCA

Exon C6

11201 CATGCACCCT CCATTTCTTT CATTTCTAGG GTATTCTCCC AACAGAAATG

11251 AGCCCTTAAC TGGGAATTCT GGTAAGTCTC AAAGAAGCCC CAGCCCAGGG

11301 TAGGGAGGGG GTAGCCTGAT GGTGCTTTGC CTTGTCCAAG AGCACCAGGC

11351 ACACAGAGTC TTGGATGAGG ATCAAAATTG CCAACCCATG GCAAAGACTA

11401 TTGAGGCATA GTAAAGGGAT AGCAGGGATC CTGGCTTTCT GGGGGCCCAG

11451 TTTTTGGGGG CATCAGAGGC ATGAGGTGTT GAGCCACTAA GCTCTCTTCC

11501 CCAGGGGCTG TGCCCATCCT CAGGCCACAT AGGGTCCAAG AAGGAGCCCT

Exon C7

11551 GGGACGTGGC AGGAGGTGGC TCACCCCAGC CCTTGTCTCC CCAGACCTTC

11601 CCTTCTGGGC TGTCATCCTC ATCGGCTTGG CAGGACTCCT GGGAGTCATC

11651 ACATGCCTGA TCTGCGGTGT CCTGGTGAGC AAGGAAGGGT TGCTTGTCTT

11701 CTTAACAATT GGGTTGTAAG AGTTCTTAAT ATATTATAAA ACCATACTAT

11751 ACTATACACA AGTCCTTTGC TGGATATATG TTTTGCAAAT ATTTTCTCCC

11801 AGTTCACGGA GTGGCTTTCC TATTTTCTTT TTATAATTTT ATTTTTAATT

11851 AATTGACAAA TAATGAATGC ATATATTTAG GGATACAAT GTGATGCTTT

11901 GGTATATGTA CAATTATGGA ATGACTCAAT CAAGCTAATT AATATGTCCC

11951 TCACCTCTCA TACTTATTAT TTCTTTGTGG TGTGAACATT GGCAACCTAT

12001 ACTCTTAGCA ATTTTGAAAT CTACATTATT ATTAACTATA GTTACTATGT

12051 TATGCAGATC TCAAAAACTT CACAACCTAT ATGCTGATTA CAAGATATTG

12101 AGAGAAAAAG TGATTGCAAA GAGTGTAAAT AAAATAATGT AAGAGGGAAA

12151 AATGTAACAA AATTAGTCGT TAGGGAAATG TACACGGAAG TCACAATGAG

12201 AGGCCACTTT TCACAAGAAT GGATAAAATT GAAAAGATTG ACTATAACAA

12251 GTGTTGGTGA AAATGTGACA GAACTGGAAC TCTCATAAAG TGAAAGTGGA

12301 AAATAGCTTG GCCATTTCTT TGAAAATTAC ACACACCTAC CGTAAGACCT

12351 ACCATCCCAC TACTAGTAAT TTATCTAAGA GAAATAAAAA CATATGTCTA

12401 TATGAAGACT TGTACACAAG TAAATGTTCA TAACAGCTTT GTTTGTAATA

12451 GCCAAACTCT GAAAACAAGC CCCTAATGTC CATTAACAAA TATATCCTGA

12501 CAATGGAATA TTATTCAGCA ACAAAAAGGA ATTATTAATA CATTAATAAA

12551 TTATACAGCA ACATGTATAA ATTGCAAAAT AGTTATGCCT AGTGAAAGAA

12601 TCCAGATGAA GAAAAGAGTA CATGCCATAT GATTCCCTTA ATAGACAAAT

12651 TCTAGAAAAT ACAAACTAAT CTGTAAGGAC AGGAATCAGA TCAGCGGTTG

12701 CCTGGGAATG AAAATGTGTT TGCAGTGGCA GGGAAAAAGG AATTGTAAAA

12751 GAGCAGGAAG AAAGTTTTTT TGTTGTTTTT TTTTGTTTT TTCTTGAGAC

12801 AGAGTCTTAG TCTATCGCCC AAGCTGGAGT GCAATGGCAC GATCTCAGCT

12851 CATTGCAACC TCTGCCTCTC GGGTTCAAGC GTTTTTCCTG CCCCAGCCTC

TABLE 29-continued

Genomic Carboxy Terminal
(SEQ ID NO: 313)

```
12901 CCAAGTAGCT GGGATTACAC ATGCGCACCA CCACACTCAG CTAATTTTTG
12951 TATTTTTAGT AGAGACGGGG TTTTACCATG TTGGCCAGGC TGGTCTCGAA
13001 CTCCTGACCT CAGGTGATCC ACCCGCCTTG GCCTCCCAAA GTGCTGGGAT
13051 TACAGGAGTG AGCCACCATG CCTGGCCAGG ACGAAAGTTT TGGGGATGAT
13101 GGATGGATGT TCCTTATGTT GATTGTGGTG ACGATTCAAT AAGTTATGAT
13151 CAGAACTTAT CAAAACATTC ACTTTAAATG TGTGCAGTTT ATTTTATGTC
13201 AGTTATGCCT CAGTTAAGCT GGACAGATGT AGAGGAGGAA GGGAGGGAGA
13251 GAGGGGGCTG AGATCAGGAC CAAAAGCCAG AGAGAAAGAG ACTGAGAATG
13301 AGATGAGAGA GAAATGGTAT TTAGACAGAA GACAGGCGAT AGATGATTGA
13351 TAGTTGACAG ATGATTGGTG GATANNNNNN NNNNNNNNNN NNNNNNNNNN
13401 NNNNNNNNNN NNNNNNNNNN NNNNNNNNNN NNNNNNNNNN NNNNNNNNNN
13451 NNNNNNNNNN NNNNNNNNNN NNNNNNNNNN NNNNNNNNNN NNNNNNNNNN
13501 AGGAGGTTTA ACAAAACGC AATTATGTTG AAATGACAAT GATTGTGGAT
13551 ATAAAGGTAG ATAGAAATAG ATATTTGTGA AGATAATGGT TAGATAAAAA
13601 TGATAGGTAA CAGATATTGA TAGATCTTGA TAAGTAGATG ATAAATACAT
13651 GATTGATGGA TGACAGGTGA TTGATAGATG ATTTGATGGA TTATAAATAG
13701 GAGATGATTG AGAGGTGAGA GATAATTGAT GGTTATTTGA TTGGTAGATA
13751 ATTGATTGAC AGGTTGATAA ATATTGATAG CTAGATGATA GATAAATAGA
13801 TCATTGGTAG ATATGTGATA TATTGATAAA GAAATTCAGA GGCAAAAGGA
13851 GAGAGAAATG AAGGGGATAT CGGAGGGGGA AAAATTTTTT TAAACCGAGA
13901 GTGAAACAAG GAGACAGAAG AAAAGAAAGT GGTGAAAAGA GGAAAAGAAC
13951 TGAGGGAGAA ATTAAATGAA ACAATGAAGG GAGACAGAGG AAGCATAAGG
```

Exon C8

```
14001 CCTCTGGCTT TGGCCATATT CTCACCCCTG TGGTCTCCTC TCCCTGGACG
14051 GCTGACCAGT CCATTCTCAC GCCTCCTCCT CACCCTCATA GGTGACCACC
14101 CGCCGGCGGA AGAAGGAAGG AGAATACAAC GTCCAGCAAC AGTGCCCAGG
14151 CTACTACCAG TCACACCTAG ACCTGGAGGA TCTGCAATGA CTGGAACTTG
14201 CCGGTGCCTG GGGTGCCTTT CCCCCAGCCA GGGTCCAAAG AAGCTTGGCT
14251 GGGGCAGAAA TAAACCATAT TGGTCGG
```

TABLE 30

Human cDNA of CA125
(SEQ ID NO: 314)

```
  1 AAGCGTTGCA CAATTCCCCC AACCTCCATA CATACGGCAG CTCTTCTAGA
 51 CACAGGTTTT CCCAGGTCAA ATGCGGGGAC CCCAGCCATA TCTCCCACCC
101 TGAGAAATTT TGGAGTTTCA GGGAGCTCAG AAGCTCTGCA GAGGCCACCC
151 TCTCTGAGGG GATTCTTCTT AGACCTCCAT CCAGAGGCAA ATGTTGACCT
201 GTCCATGCTG AAACCCTCAG GCCTTCCTGG GTCATCTTCT CCCACCCGCT
```

TABLE 30-continued

Human cDNA of CA125
(SEQ ID NO: 314)

| | |
|---|---|
| 251 | CCTTGATGAC AGGGAGCAGG AGCACTAAAG CCACACCAGA AATGGATTCA |
| 301 | GGACTGACAG GAGCCACCTT GTCACCTAAG ACATCTACAG GTGCAATCGT |
| 351 | GGTGACAGAA CATACTCTGC CCTTTACTTC CCCAGATAAG ACCTTGGCCA |
| 401 | GTCCTACATC TTCGGTTGTG GGAAGAACCA CCCAGTCTTT GGGGGTGATG |
| 451 | TCCTCTGCTC TCCCTGAGTC AACCTCTAGA GGAATGACAC ACTCCGAGCA |
| 501 | AAGAACCAGC CCATCGCTGA GTCCCCAGGT CAATGGAACT CCCTCTAGGA |
| 551 | ACTACCCTGC TACAAGCATG GTTTCAGGAT TGAGTTCCCC AAGGACCAGG |
| 601 | ACCAGTTCCA CAGAAGGAAA TTTTACCAAA GAAGCATCTA CATACACACT |
| 651 | CACTGTAGAG ACCACAAGTG GCCCAGTCAC TGAGAAGTAC ACAGTCCCCA |
| 701 | CTGAGACCTC AACAACTGAA GGTGACAGCA CAGAGACCCC CTGGGACACA |
| 751 | AGATATATTC CTGTAAAAAT CACATCTCCA ATGAAAACAT TTGCAGATTC |
| 801 | AACTGCATCC AAGGAAAATG CCCCAGTGTC TATGACTCCA GCTGAGACCA |
| 851 | CAGTTACTGA CTCACATACT CCAGGAAGGA CAAACCCATC ATTTGGGACA |
| 901 | CTTTATTCTT CCTTCCTTGA CCTATCACCT AAAGGGACCC CAAATTCCAG |
| 951 | AGGTGAAACA AGCCTGGAAC TGATTCTATC AACCACTGGA TATCCCTTCT |
| 1001 | CCTCTCCTGA ACCTGGCTCT GCAGGACACA GCAGAATAAG TACCAGTGCG |
| 1051 | CCTTTGTCAT CATCTGCTTC AGTTCTCGAT AATAAAATAT CAGAGACCAG |
| 1101 | CATATTCTCA GGCCAGAGTC TCACCTCCCC TCTGTCTCCT GGGGTGCCCG |
| 1151 | AGGCCAGAGC CAGCACAATG CCCAACTCAG CTATCCCTTT TTCCATGACA |
| 1201 | CTAAGCAATG CAGAAACAAG TGCCGAAAGG GTCAGAAGCA CAATTTCCTC |
| 1251 | TCTGGGGACT CCATCAATAT CCACAAAGCA GACAGCAGAG ACTATCCTTA |
| 1301 | CCTTCCATGC CTTCGCTGAG ACCATGGATA TACCCAGCAC CCACATAGCC |
| 1351 | AAGACTTTGG CTTCAGAATG GTTGGGAAGT CCAGGTACCC TTGGTGGCAC |
| 1401 | CAGCACTTCA GCGCTGACAA CCACATCTCC ATCTACCACT TTAGTCTCAG |
| 1451 | AGGAGACCAA CACCCATCAC TCCACGAGTG GAAAGGAAAC AGAAGGAACT |
| 1501 | TTGAATACAT CTATGACTCC ACTTGAGACC TCTGCTCCTG GAGAAGAGTC |
| 1551 | CGAAATGACT GCCACCTTGG TCCCCACTCT AGGTTTTACA ACTCTTGACA |
| 1601 | GCAAGATCAG AAGTCCATCT CAGGTCTCTT CATCCCACCC AACAAGAGAG |
| 1651 | CTCAGAACCA CAGGCAGCAC CTCTGGGAGG CAGAGTTCCA GCACAGCTGC |
| 1701 | CCACGGGAGC TCTGACATCC TGAGGGCAAC CACTTCCAGC ACCTCAAAAG |
| 1751 | CATCATCATG GACCAGTGAA AGCACAGCTC AGCAATTTAG TGAACCCCAG |
| 1801 | CACACACAGT GGGTGGAGAC AAGTCCTAGC ATGAAAACAG AGAGACCCCC |
| 1851 | AGCATCAACC AGTGTGGCAG CCCCTATCAC CACTTCTGTT CCCTCAGTGG |
| 1901 | TCTCTGGCTT CACCACCCTG AAGACCAGCT CCACAAAAGG GATTTGGCTT |
| 1951 | GAAGAAACAT CTGCAGACAC ACTCATCGGA GAATCCACAG CTGGCCCAAC |
| 2001 | CACCCATCAG TTTGCTGTTC CCACTGGGAT TCAATGACA GGAGGCAGCA |
| 2051 | GCACCAGGGG AAGCCAGGGC ACAACCCACC TACTCACCAG AGCCACAGCA |
| 2101 | TCATCTGAGA CATCCGCAGA TTTGACTCTG GCCACGAACG GTGTCCCAGT |
| 2151 | CTCCGTGTCT CCAGCAGTGA GCAAGACGGC TGCTGGCTCA AGTCCTCCAG |

TABLE 30-continued

Human cDNA of CA125
(SEQ ID NO: 314)

```
2201  GAGGGACAAA GCCATCATAT ACAATGGTTT CTTCTGTCAT CCCTGAGACA
2251  TCATCTCTAC AGTCCTCAGC TTTCAGGGAA GGAACCAGCC TGGGACTGAC
2301  TCCATTAAAC ACTAGACATC CCTTCTCTTC CCCTGAACCA GACTCTGCAG
2351  GACACACCAA GATAAGCACC AGCATTCCTC TGTTGTCATC TGCTTCAGTT
2401  CTTGAGGATA AAGTGTCAGC GACCAGCACA TTCTCACACC ACAAAGCCAC
2451  CTCATCTATT ACCACAGGGA CTCCTGAAAT CTCAACAAAG ACAAAGCCCA
2501  GCTCAGCCGT TCTTTCCTCC ATGACCCTAA GCAATGCAGC AACAAGTCCT
2551  GAAAGAGTCA GAAATGCAAC TTCCCCTCTG ACTCATCCAT CTCCATCAGG
2601  GGAAGAGACA GCAGGGAGTG TCCTCACTCT CAGCACCTCT GCTGAGACTA
2651  CAGACTCACC TAACATCCAC CCAACTGGGA CACTGACTTC AGAATCGTCA
2701  GAGAGTCCTA GCACTCTCAG CCTCCCAAGT GTCTCTGGAG TCAAAACCAC
2751  ATTTTCTTCA TCTACTCCTT CCACTCATCT ATTTACTAGT GGAGAAGAAA
2801  CAGAGGAAAC TTCGAATCCA TCTGTGTCTC AACCTGAGAC TTCTGTTTCC
2851  AGAGTAAGGA CCACCTTGGC CAGCACCTCT GTCCCTACCC CAGTATTCCC
2901  CACCATGGAC ACCTGGCCTA CACGTTCAGC TCAGTTCTCT TCATCCCACC
2951  TAGTGAGTGA GCTCAGAGCT ACGAGCAGTA CCTCAGTTAC AAACTCAACT
3001  GGTTCAGCTC TTCCTAAAAT ATCTCACCTC ACTGGGACGG CAACAATGTC
3051  ACAGACCAAT AGAGACACGT TAATGACTC TGCTGCACCC CAAAGCACAA
3101  CTTGGCCAGA GACTAGTCCC AGATTCAAGA CAGGGTTACC TTCAGCAACA
3151  ACCACTGTTT CAACCTCTGC CACTTCTCTC TCTGCTACTG TAATGGTCTC
3201  TAAATTCACT TCTCCAGCAA CTAGTTCCAT GGAAGCAACT TCTATCAGGG
3251  AACCATCAAC AACCATCCTC ACAACAGAGA CCACGAATGG CCCAGGCTCT
3301  ATGGCTGTGG CTTCTACCAA CATCCCAATT GGAAAGGGCT ACATTACTGA
3351  AGGAAGATTG GACACAAGCC ATCTGCCCAT GGAACCACA GCTTCCTCTG
3401  AGACATCTAT GGATTTTACC ATGGCCAAAG AAAGTGTCTC AATGTCAGTA
3451  TCTCCATCTC AGTCCATGGA TGCTGCTGGC TCAAGCACTC CAGGAAGGAC
3501  AAGCCAATTC GTTGACACAT TTTCTGATGA TGTCTATCAT TTAACATCCA
3551  GAGAAATTAC AATACCTAGA GATGGAACAA GCTCAGCTCT GACTCCACAA
3601  ATGACTGCAA CTCACCCTCC ATCTCCTGAT CCTGGCTCTG CTAGAAGCAC
3651  CTGGCTTGGC ATCTTGTCCT CATCTCCTTC TTCTCCTACT CCCAAAGTCA
3701  CAATGAGCTC CACATTTTCA ACTCAGAGAG TCACCACAAG CATGATAATG
3751  GACACAGTTG AAACTAGTCG GTGGAACATG CCCAACTTAC CTTCCACGAC
3801  TTCCCTGACA CCAAGTAATA TTCCAACAAG TGGTGCCATA GGAAAAAGCA
3851  CCCTGGTTCC CTTGGACACT CCATCTCCAG CCACATCATT GGAGGCATCA
3901  GAAGGGGGAC TTCCAACCCT CAGCACCTAC CCTGAATCAA CAAACACACC
3951  CAGCATCCAC CTCGGAGCAC ACGCTAGTTC AGAAAGTCCA AGCACCATCA
4001  AACTTACCAT GGCTTCAGTA GTAAAACCTG GCTCTTACAC ACCTCTCACC
4051  TTCCCCTCAA TAGAGACCCA CATTCATGTA TCAACAGCCA GAATGGCTTA
```

TABLE 30-continued

Human cDNA of CA125
(SEQ ID NO: 314)

```
4101  CTCTTCTGGG TCTTCACCTG AGATGACAGC TCCTGGAGAG ACTAACACTG
4151  GTAGTACCTG GGACCCCACC ACCTACATCA CCACTACGGA TCCTAAGGAT
4201  ACAAGTTCAG CTCAGGTCTC TACACCCCAC TCAGTGAGGA CACTCAGAAC
4251  CACAGAAAAC CATCCAAAGA CAGAGTCCGC CACCCCAGCT GCTTACTCTG
4301  GAAGTCCTAA AATCTCAAGT TCACCCAATC TCACCAGTCC GGCCACAAAA
4351  GCATGGACCA TCACAGACAC AACTGAACAC TCCACTCAAT TACATTACAC
4401  AAAATTGGCA GAAAAATCAT CTGGATTTGA GACACAGTCA GCTCCAGGAC
4451  CTGTCTCTGT AGTAATCCCT ACCTCCCCTA CCATTGGAAG CAGCACATTG
4501  GAACTAACTT CTGATGTCCC AGGGGAACCC CTGGTCCTTG CTCCCAGTGA
4551  GCAGACCACA ATCACTCTCC CCATGGCAAC ATGGCTGAGT ACCAGTTTGA
4601  CAGAGGAAAT GGCTTCAACA GACCTTGATA TTTCAAGTCC AAGTTCACCC
4651  ATGAGTACAT TTGCTATTTT TCCACCTATG TCCACACCTT CTCATGAACT
4701  TTCAAAGTCA GAGGCAGATA CCAGTGCCAT TAGAAATACA GATTCAACAA
4751  CGTTGGATCA GCACCTAGGA ATCAGGAGTT TGGGCAGAAC TGGGGACTTA
4801  ACAACTGTTC CTATCACCCC ACTGACAACC ACGTGGACCA GTGTGATTGA
4851  ACACTCAACA CAAGCACAGG ACACCCTTTC TGCAACGATG AGTCCTACTC
4901  ACGTGACACA GTCACTCAAA GATCAAACAT CTATACCAGC CTCAGCATCC
4951  CCTTCCCATC TTACTGAAGT CTACCCTGAG CTCGGGACAC AAGGGAGAAG
5001  CTCCTCTGAG GCAACCACTT TTTGGAAACC ATCTACAGAC ACACTGTCCA
5051  GAGAGATTGA GACTGGCCCA ACAAACATTC AATCCACTCC ACCCATGGAC
5101  AACACAACAA CAGGGAGCAG TAGTAGTGGA GTCACCCTGG CATAGCCCA
5151  CCTTCCCATA GGAACATCCT CCCCAGCTGA GACATCCACA AACATGGCAC
5201  TGGAAAGAAG AAGTTCTACA GCCACTGTCT CTATGGCTGG GACAATGGGA
5251  CTCCTTGTTA CTAGTGCTCC AGGAAGAAGC ATCAGCCAGT CATTAGGAAG
5301  AGTTTCCTCT GTCCTTTCTG AGTCAACTAC TGAAGGAGTC ACAGATTCTA
5351  GTAAGGGAAG CAGCCCAAGG CTGAACACAC AGGGAAATAC AGCTCTCTCC
5401  TCCTCTCTTG AACCCAGCTA TGCTGAAGGA AGCCAGATGA GCACAAGCAT
5451  CCCTCTAACC TCATCTCCTA CAACTCCTGA TGTGGAATTC ATAGGGGGCA
5501  GCACATTTTG GACCAAGGAG GTCACCACAG TTATGACCTC AGACATCTCC
5551  AAGTCTTCAG CAAGGACAGA GTCCAGCTCA GCTACCCTTA TGTCCACAGC
5601  TTTGGGAAGC ACTGAAAATA CAGGAAAAGA AAAACTCAGA ACTGCCTCTA
5651  TGGATCTTCC ATCTCCAACT CCATCAATGG AGGTGACACC ATGGATTTCT
5701  CTCACTCTCA GTAATGCCCC CAATACCACA GATTCACTTG ACCTCAGCCA
5751  TGGGGTGCAC ACCAGCTCTG CAGGGACTTT GGCCACTGAC AGGTCATTGA
5801  ATACTGGTGT CACTAGAGCC TCCAGATTGG AAAACGGCTC TGATACCTCT
5851  TCTAAGTCCC TGTCTATGGG AAACAGCACT CACACTTCCA TGACTGACAC
5901  AGAGAAGAGT GAAGTGTCTT CTTCAATCCA TCCCCGACCT GAGACCTCAG
5951  CTCCTGGAGC AGAGACCACT TTGACTTCCA CTCCTGGAAA CAGGGCCATA
6001  AGCTTAACAT TGCCTTTTTC ATCCATTCCA GTGGAAGAAG TCATTTCTAC
```

TABLE 30-continued

Human cDNA of CA125
(SEQ ID NO: 314)

```
6051  AGGCATAACC TCAGGACCAG ACATCAACTC AGCACCCATG ACACATTCTC
6101  CCATCACCCC ACCAACAATT GTATGGACCA GTACAGGCAC AATTGAACAG
6151  TCCACTCAAC CACTACATGC AGTTTCTTCA GAAAAAGTTT CTGTGCAGAC
6201  ACAGTCAACT CCATATGTCA ACTCTGTGGC AGTGTCTGCT TCCCCTACCC
6251  ATGAGAATTC AGTCTCTTCT GGAAGCAGCA CATCCTCTCC ATATTCCTCA
6301  GCCTCACTTG AATCCTTGGA TTCCACAATC AGTAGGAGGA ATGCAATCAC
6351  TTCCTGGCTA TGGGACCTCA CTACATCTCT CCCCACTACA ACTTGGCCAA
6401  GTACTAGTTT ATCTGAGGCA CTGTCCTCAG GCCATTCTGG GGTTTCAAAC
6451  CCAAGTTCAA CTACGACTGA ATTTCCACTC TTTTCAGCTG CATCCACATC
6501  TGCTGCTAAG CAAAGAAATC CAGAAACAGA GACCCATGGT CCCCAGAATA
6551  CAGCCGCGAG TACTTTGAAC ACTGATGCAT CCTCGGTCAC AGGTCTTTCT
6601  GAGACTCCTG TGGGGCAAG TATCAGCTCT GAAGTCCCTC TTCCAATGGC
6651  CATAACTTCT AGATCAGATG TTTCTGGCCT TACATCTGAG AGTACTGCTA
6701  ACCCGAGTTT AGGCACAGCC TCTTCAGCAG GGACCAAATT AACTAGGACA
6751  ATATCCCTGC CCACTTCAGA GTCTTTGGTT TCCTTTAGAA TGAACAAGGA
6801  TCCATGGACA GTGTCAATCC CTTTGGGGTC CCATCCAACT ACTAATACAG
6851  AAACAAGCAT CCCAGTAAAC AGCGCAGGTC CACCTGGCTT GTCCACAGTA
6901  GCATCAGATG TAATTGACAC ACCTTCAGAT GGGGCTGAGA GTATTCCCAC
6951  TGTCTCCTTT TCCCCCTCCC CTGATACTGA AGTGACAACT ATCTCACATT
7001  TCCCAGAAAA GACAACTCAT TCATTTAGAA CCATTTCATC TCTCACTCAT
7051  GAGTTGACTT CAAGAGTGAC ACCTATTCCT GGGGATTGGA TGAGTTCAGC
7101  TATGTCTACA AAGCCCACAG GAGCCAGTCC CTCCATTACA CTGGGAGAGA
7151  GAAGGACAAT CACCTCTGCT GCTCCAACCA CTTCCCCCAT AGTTCTCACT
7201  GCTAGTTTCA CAGAGACCAG CACAGTTTCA CTGGATAATG AAACTACAGT
7251  AAAAACCTCA GATATCCTTG ACGCACGGAA AACAAATGAG CTCCCCTCAG
7301  ATAGCAGTTC TTCTTCTGAT CTGATCAACA CCTCCATAGC TTCTTCAACT
7351  ATGGATGTCA CTAAAACAGC CTCCATCAGT CCCACTAGCA TCTCAGGAAT
7401  GACAGCAAGT TCCTCCCCAT CTCTCTTCTC TTCAGATAGA CCCCAGGTTC
7451  CCACATCTAC AACAGAGACA AATACAGCCA CCTCTCCATC TGTTTCCAGT
7501  AACACCTATT CTCTTGATGG GGGCTCCAAT GTGGGTGGCA CTCCATCCAC
7551  TTTACCACCC TTTACAATCA CCCACCCTGT CGAGACAAGC TCGGCCCTAT
7601  TAGCCTGGTC TAGACCAGTA AGAACTTTCA GCACCATGGT CAGCACTGAC
7651  ACTGCCTCCG GAGAAAATCC TACCTCTAGC AATTCTGTGG TGACTTCTGT
7701  TCCAGCACCA GGTACATGGG CCAGTGTAGG CAGTACTACT GACTTACCTG
7751  CCATGGGCTT TCTCAAGACA AGTCCTGCAG GAGAGGCACA CTCACTTCTA
7801  GCATCAACTA TTGAACCAGC CACTGCCTTC ACTCCCCATC TCTCAGCAGC
7851  AGTGGTCACT GGATCCAGTG CTACATCAGA AGCCAGTCTT CTCACTACGA
7901  GTGAAAGCAA AGCCATTCAT TCTTCACCAC AGACCCCAAC TACACCCACC
```

TABLE 30-continued

Human cDNA of CA125
(SEQ ID NO: 314)

```
7951  TCTGGAGCAA ACTGGGAAAC TTCAGCTACT CCTGAGAGCC TTTTGGTAGT
8001  CACTGAGACT TCAGACACAA CACTTACCTC AAAGATTTTG GTCACAGATA
8051  CCATCTTGTT TTCAACTGTG TCCACGCCAC CTTCTAAATT TCCAAGTACG
8101  GGGACTCTGT CTGGAGCTTC CTTCCCTACT TTACTCCCGG ACACTCCAGC
8151  CATCCCTCTC ACTGCCACTG AGCCAACAAG TTCATTAGCT ACATCCTTTG
8201  ATTCCACCCC ACTGGTGACT ATAGCTTCGG ATAGTCTTGG CACAGTCCCA
8251  GAGACTACCC TGACCATGTC AGAGACCTCA AATGGTGATG CACTGGTTCT
8301  TAAGACAGTA AGTAACCCAG ATAGGAGCAT CCCTGGAATC ACTATCCAAG
8351  GAGTAACAGA AAGTCCACTC CATCCTTCTT CCACTTCCCC CTCTAAGATT
8401  GTTGCTCCAC GGAATACAAC CTATGAAGGT TCGATCACAG TGGCACTTTC
8451  TACTTTGCCT GCGGGAACTA CTGGTTCCCT TGTATTCAGT CAGAGTTCTG
8501  AAAACTCAGA GACAACGGCT TTGGTAGACT CATCAGCTGG GCTTGAGAGG
8551  GCATCTGTGA TGCCACTAAC CACAGGAAGC CAGGGTATGG CTAGCTCTGG
8601  AGGAATCAGA AGTGGGTCCA CTCACTCAAC TGGAACCAAA ACATTTTCTT
8651  CTCTCCCTCT GACCATGAAC CCAGGTGAGG TTACAGCCAT GTCTGAAATC
8701  ACCACGAACA GACTGACAGC TACTCAATCA ACAGCACCCA AAGGGATACC
8751  TGTGAAGCCC ACCAGTGCTG AGTCAGGCCT CCTAACACCT GTCTCTGCCT
8801  CCTCAAGCCC ATCAAAGGCC TTTGCCTCAC TGACTACAGC TCCCCCATCA
8851  ACTTGGGGGA TCCCACAGTC TACCTTGACA TTTGAGTTTT CTGAGGTCCC
8901  AAGTTTGGAT ACTAAGTCCG CTTCTTTACC AACTCCTGGA CAGTCCCTGA
8951  ACACCATTCC AGACTCAGAT GCAAGCACAC CATCTTCCTC ACTGTCCAAG
9001  TCTCCAGAAA AAAACCCAAG GGCAAGGATG ATGACTTCCA CAAAGGCCAT
9051  AAGTGCAAGC TCATTTCAAT CAACAGGTTT TACTGAAACC CCTGAGGGAT
9101  CTGCCTCCCC TTCTATGGCA GGGCATGAAC CCAGAGTCCC CACTTCAGGA
9151  ACAGGGGACC CTAGATATGC CTCAGAGAGC ATGTCTTATC CAGACCCAAG
9201  CAAGGCATCA TCAGCTATGA CATCGACCTC TCTTGCATCA AAACTCACAA
9251  CTCTCTTCAG CACAGGTCAA GCAGCAAGGT CTGGTTCTAG TTCCTCTCCC
9301  ATAAGCCTAT CCACTGAGAA AGAAACAAGC TTCCTTTCCC CCACTGCATC
9351  CACCTCCAGA AAGACTTCAC TATTTCTTGG GCCTTCCATG GCAAGGCAGC
9401  CCAACATATT GGTGCATCTT CAGACTTCAG CTCTGACACT TTCTCCAACA
9451  TCCACTCTAA ATATGTCCCA GGAGGAGCCT CCTGAGTTAA CCTCAAGCCA
9501  GACCATTGCA GAAGAAGAGG GAACAACAGC TGAAACACAG ACGTTAACCT
9551  TCACACCATC TGAGACCCCA ACATCCTTGT TACCTGTCTC TTCTCCCACA
9601  GAACCCACAG CCAGAAGAAA GAGTTCTCCA GAAACATGGG CAAGCTCTAT
9651  TTCAGTTCCT GCCAAGACCT CCTTGGTTGA AACAACTGAT GGAACGCTAG
9701  TGACCACCAT AAAGATGTCA AGCCAGGCAG CACAAGGAAA TTCCACGTGG
9751  CCTGCCCCAG CAGAGGGAGA CGGGGACCAGT CCAGCAGGCA CATCCCCAGG
9801  AAGCCCAGAA GTGTCTACCA CTCTCAAAAT CATGAGCTCC AAGGAACCCA
9851  GCATCAGCCC AGAGATCAGG TCCACTGTGC GAAATTCTCC TTGGAAGACT
```

TABLE 30-continued

Human cDNA of CA125
(SEQ ID NO: 314)

```
 9901 CCAGAAACAA CTGTTCCCAT GGAGACCACA GTGGAACCAG TCACCCTTCA
 9951 GTCCACAGCC CTAGGAAGTG GCAGCACCAG CATCTCTCAC CTGCCCACAG
10001 GAACCACATC ACCAACCAAG TCACCAACAG AAAATATGTT GGCTACAGAA
10051 AGGGTCTCCC TCTCCCCATC CCCACCTGAG GCTTGGACCA ACCTTTATTC
10101 TGGAACTCCA GGAGGGACCA GGCAGTCACT GGCCACAATG TCCTCTGTCT
10151 CCCTAGAGTC ACCAACTGCT AGAAGCATCA CAGGGACTGG TCAGCAAAGC
10201 AGTCCAGAAC TGGTTTCAAA GACAACTGGA ATGGAATTCT CTATGTGGCA
10251 TGGCTCTACT GGAGGGACCA CAGGGGACAC ACATGTCTCT CTGAGCACAT
10301 CTTCCAATAT CCTTGAAGAC CCTGTAACCA GCCCAAACTC TGTGAGCTCA
10351 TTGACAGATA AATCCAAACA TAAAACCGAG ACATGGGTAA GCACCACAGC
10401 CATTCCCTCC ACTGTCCTGA ATAATAAGAT AATGGCAGCT GAACAACAGA
10451 CAAGTCGATC TGTGGATGAG GCTTATTCAT CAACTAGTTC TTGGTCAGAT
10501 CAGACATCTG GGAGTGACAT CACCCTTGGT GCATCCCTG ATGTCACAAA
10551 CACATTATAC ATCACCTCCA CAGCACAAAC CACCTCACTA GTGTCTCTGC
10601 CCTCTGGAGA CCAAGGCATT ACAAGCCTCA CCAATCCCTC AGGAGGAAAA
10651 ACAAGCTCTG CGTCATCTGT CACATCTCCT TCAATAGGGC TTGAGACTCT
10701 GAGGGCCAAT GTAAGTGCAG TGAAAAGTGA CATTGCCCCT ACTGCTGGGC
10751 ATCTATCTCA GACTTCATCT CCTGCGGAAG TGAGCATCCT GGACGTAACC
10801 ACAGCTCCTA CTCCAGGTAT CTCCACCACC ATCACCACCA TGGGAACCAA
10851 CTCAATCTCA ACTACCACAC CCAACCCAGA AGTGGGTATG AGTACCATGG
10901 ACAGCACCCC GGCCACAGAG AGGCGCACAA CTTCTACAGA ACACCCTTCC
10951 ACCTGGTCTT CCACAGCTGC ATCAGATTCC TGGACTGTCA CAGACATGAC
11001 TTCAAACTTG AAAGTTGCAA GATCTCCTGG AACAATTTCC ACAATGCATA
11051 CAACTTCATT CTTAGCCTCA AGCACTGAAT TAGACTCCAT GTCTACTCCC
11101 CATGGCCGTA TAACTGTCAT TGGAACCAGC CTGGTCACTC CATCCTCTGA
11151 TGCTTCAGCT GTAAAGACAG AGACCAGTAC AAGTGAAAGA ACATTGAGTC
11201 CTTCAGACAC AACTGCATCT ACTCCCATCT CAACTTTTTC TCGTGTCCAG
11251 AGGATGAGCA TCTCAGTTCC TGACATTTTA AGTACAAGTT GGACTCCCAG
11301 TAGTACAGAA GCAGAAGATG TGCCTGTTTC AATGGTTTCT ACAGATCATG
11351 CTAGTACAAA GACTGACCCA AATACGCCCC TGTCCACTTT TCTGTTTGAT
11401 TCTCTGTCCA CTCTTGACTG GGACACTGGG AGATCTCTGT CATCAGCCAC
11451 AGCCACTACC TCAGCTCCTC AGGGGCCAC AACTCCCCAG GAACTCACTT
11501 TGGAAACCAT GATCAGCCCA GCTACCTCAC AGTTGCCCTT CTCTATAGGG
11551 CACATTACAA GTGCAGTCAC ACCAGCTGCA ATGGCAAGGA GCTCTGGAGT
11601 TACTTTTTCA AGACCAGATC CCACAAGCAA AAAGGCAGAG CAGACTTCCA
11651 CTCAGCTTCC CACCACCACT TCTGCACATC CAGGGCAGGT GCCCAGATCA
11701 GCAGCAACAA CTCTGGATGT GATCCCACAC ACAGCAAAAA CTCCAGATGC
11751 AACTTTTCAG AGACAAGGGC AGACAGCTCT TACAACAGAG GCAAGAGCTA
```

TABLE 30-continued

Human cDNA of CA125
(SEQ ID NO: 314)

```
11801  CATCTGACTC CTGGAATGAG AAAGAAAAAT CAACCCCAAG TGCACCTTGG

11851  ATCACTGAGA TGATGAATTC TGTCTCAGAA GATACCATCA AGGAGGTTAC

11901  CAGCTCCTCC AGTGTATTAA AGGACCCTGA ATACGCTGGA CATAAACTTG

11951  GAATCTGGGA CGACTTCATC CCCAAGTTTG GAAAAGCAGC CCATATGAGA

12001  GAGTTGCCCC TTCTGAGTCC ACCACAGGAC AAAGAGGCAA TTCACCCTTC

12051  TACAAACACA GTAGAGACCA CAGGCTGGGT CACAAGTTCC GAACATGCTT

12101  CTCATTCCAC TATCCCAGCC CACTCAGCGT CATCCAAACT CACATCTCCA

12151  GTGGTTACAA CCTCCACCAG GAACAAGCA ATAGTTTCTA TGTCAACAAC

12201  CACATGGCCA GAGTCTACAA GGGCTAGAAC AGAGCCTAAT TCCTTCTTGA

12251  CTATTGAACT GAGGGACGTC AGCCCTTACA TGGACACCAG CTCAACCACA

12301  CAAACAAGTA TTATCTCTTC CCCAGGTTCC ACTGCGATCA CCAAGGGGCC

12351  TAGAACAGAA ATTACCTCCT CTAAGAGAAT ATCCAGCTCA TTCCTTGCCC

12401  AGTCTATGAG GTCGTCAGAC AGCCCCTCAG AAGCCATCAC CAGGCTGTCT

12451  AACTTTCCTG CCATGACAGA ATCTGGAGGA ATGATCCTTG CTATGCAAAC

12501  AAGTCCACCT GGCGCTACAT CACTAAGTGC ACCTACTTTG GATACATCAG

12551  CCACAGCCTC CTGGACAGGG ACTCCACTGG CTACGACTCA GAGATTTACA

12601  TACTCAGAGA AGACCACTCT CTTTAGCAAA GGTCCTGAGG ATACATCACA

12651  GCCAAGCCCT CCCTCTGTGG AAGAAACCAG CTCTTCCTCT TCCCTGGTAC

12701  CTATCCATGC TACAACCTCG CCTTCCAATA TTTTGTTGAC ATCACAAGGG

12751  CACAGTCCCT CCTCTACTCC ACCTGTGACC TCAGTTTTCT TGTCTGAGAC

12801  CTCTGGCCTG GGAAGACCA CAGACATGTC GAGGATAAGC TTGGAACCTG

12851  GCACAAGTTT ACCTCCCAAT TTGAGCAGTA CAGCAGGTGA GGCGTTATCC

12901  ACTTATGAAG CCTCCAGAGA TACAAAGGCA ATTCATCATT CTGCAGACAC

12951  AGCAGTGACG AATATGGAGG CAACCAGTTC TGAATATTCT CCTATCCCAG

13001  GCCATACAAA GCCATCCAAA GCCACATCTC CATTGGTTAC CTCCCACATC

13051  ATGGGGGACA TCACTTCTTC CACATCAGTA TTTGGCTCCT CCGAGACCAC

13101  AGAGATTGAG ACAGTGTCCT CTGTGAACCA GGGACTTCAG GAGAGAAGCA

13151  CATCCCAGGT GGCCAGCTCT GCTACAGAGA CAAGCACTGT CATTACCCAT

13201  GTGTCTAGTG GTGATGCTAC TACTCATGTC ACCAAGACAC AAGCCACTTT

13251  CTCTAGCGGA ACATCCATCT CAAGCCCTCA TCAGTTTATA ACTTCTACCA

13301  ACACATTTAC AGATGTGAGC ACCAACCCCT CCACCTCTCT GATAATGACA

13351  GAATCTTCAG GAGTGACCAT CACCACCCAA ACAGGTCCTA CTGGAGCTGC

13401  AACACAGGGT CCATATCTCT TGGACACATC AACCATGCCT TACTTGACAG

13451  AGACTCCATT AGCTGTGACT CCAGATTTTA TGCAATCAGA GAAGACCACT

13501  CTCATAAGCA AAGGTCCCAA.GGATGTGACC TGGACAAGCC CTCCCTCTGT

13551  GGCAGAAACC AGCTATCCCT CTTCCCTGAC ACCTTTCTTG GTCACAACCA

13601  TACCTCCTGC CACTTCCACG TTACAAGGGC AACATACATC CTCTCCTGTT

13651  TCTGCGACTT CAGTTCTTAC CTCTGGACTG GTGAAGACCA CAGATATGTT

13701  GAACACAAGC ATGGAACCTG TGACCAATTC ACCTCAAAAT TTGAACAATC
```

TABLE 30-continued

Human cDNA of CA125
(SEQ ID NO: 314)

```
13751  CATCAAATGA GATACTGGCC ACTTTGGCAG CCACCACAGA TATAGAGACT
13801  ATTCATCCTT CCATAAACAA AGCAGTGACC AATATGGGGA CTGCCAGTTC
13851  AGCACATGTA CTGCATTCCA CTCTCCCAGT CAGCTCAGAA CCATCTACAG
13901  CCACATCTCC AATGGTTCCT GCCTCCAGCA TGGGGACGC TCTTGCTTCT
13951  ATATCAATAC CTGGTTCTGA GACCACAGAC ATTGAGGGAG AGCCAACATC
14001  CTCCCTGACT GCTGGACGAA AAGAGAACAG CACCCTCCAG GAGATGAACT
14051  CAACTACAGA GTCAAACATC ATCCTCTCCA ATGTGTCTGT GGGGGCTATT
14101  ACTGAAGCCA CAAAAATGGA AGTCCCCTCT TTTGATGCAA CATTCATACC
14151  AACTCCTGCT CAGTCAACAA AGTTCCCAGA TATTTTCTCA GTAGCCAGCA
14201  GTAGACTTTC AAACTCTCCT CCCATGACAA TATCTACCCA CATGACCACC
14251  ACCCAGACAG GGTCTTCTGG AGCTACATCA AAGATTCCAC TTGCCTTAGA
14301  CACATCAACC TTGGAAACCT CAGCAGGGAC TCCATCAGTG GTGACTGAGG
14351  GGTTTGCCCA CTCAAAAATA ACCACTGCAA TGAACAATGA TGTCAAGGAC
14401  GTGTCACAGA CAAACCCTCC CTTTCAGGAT GAAGCCAGCT CTCCCTCTTC
14451  TCAAGCACCT GTCCTTGTCA CAACCTTACC TTCTTCTGTT GCTTTCACAC
14501  CGCAATGGCA CAGTACCTCC TCTCCTGTTT CTATGTCCTC AGTTCTTACT
14551  TCTTCACTGG TAAAGACCGC AGGCAAGGTG GATACAAGCT TAGAAACAGT
14601  GACCAGTTCA CCTCAAAGTA TGAGCAACAC TTTGGATGAC ATATCGGTCA
14651  CTTCAGCAGC CACCACAGAT ATAGAGACAA CGCATCCTTC CATAAACACA
14701  GTAGTTACCA ATGTGGGGAC CACCGGTTCA GCATTTGAAT CACATTCTAC
14751  TGTCTCAGCT TACCCAGAGC CATCTAAAGT CACATCTCCA AATGTTACCA
14801  CCTCCACCAT GGAAGACACC ACAATTTCCC GATCAATACC TAAATCCTCT
14851  AAGACTACAA GAACTGAGAC TGAGACAACT TCCTCCCTGA CTCCTAAACT
14901  GAGGGAGACC AGCATCTCCC AGGAGATCAC CTCGTCCACA GAGACAAGCA
14951  CTGTTCCTTA CAAAGAGCTC ACTGGTGCCA CTACCGAGGT ATCCAGGACA
15001  GATGTCACTT CCTCTAGCAG TACATCCTTC CCTGGCCCTG ATCAGTCCAC
15051  AGTGTCACTA GACATCTCCA CAGAAACCAA CACCAGGCTG TCTACCTCCC
15101  CAATAATGAC AGAATCTGCA GAAATAACCA TCACCACCCA AACAGGTCCT
15151  CATGGGGCTA CATCACAGGA TACTTTTACC ATGGACCCAT CAAATACAAC
15201  CCCCCAGGCA GGGATCCACT CAGCTATGAC TCATGGATTT TCACAATTGG
15251  ATGTGACCAC TCTTATGAGC AGAATTCCAC AGGATGTATC ATGGACAAGT
15301  CCTCCCTCTG TGGATAAAAC CAGCTCCCCC TCTTCCTTTC TGTCCTCACC
15351  TGCAATGACC ACACCTTCCC TGATTTCTTC TACCTTACCA GAGGATAAGC
15401  TCTCCTCTCC TATGACTTCA CTTCTCACCT CTGGCCTAGT GAAGATTACA
15451  GACATATTAC GTACACGCTT GGAACCTGTG ACCAGCTCAC TTCCAAATTT
15501  CAGCAGCACC TCAGATAAGA TACTGGCCAC TTCTAAAGAC AGTAAAGACA
15551  CAAAGGAAAT TTTTCCTTCT ATAAACACAG AAGAGACCAA TGTGAAAGCC
15601  AACAACTCTG GACATGAATC CCATTCCCCT GCACTGGCTG ACTCAGAGAC
```

TABLE 30-continued

Human cDNA of CA125
(SEQ ID NO: 314)

```
15651  ACCCAAAGCC ACAACTCAAA TGGTTATCAC CACCACTGTG GGAGATCCAG
15701  CTCCTTCCAC ATCAATGCCA GTGCATGGTT CCTCTGAGAC TACAAACATT
15751  AAGAGAGAGC CAACATATTT CTTGACTCCT AGACTGAGAG AGACCAGTAC
15801  CTCTCAGGAG TCCAGCTTTC CCACGGACAC AAGTTTTCTA CTTTCCAAAG
15851  TCCCCACTGG TACTATTACT GAGGTCTCCA GTACAGGGGT CAACTCTTCT
15901  AGCAAAATTT CCACCCCAGA CCATGATAAG TCCACAGTGC CACCTGACAC
15951  CTTCACAGGA GAGATCCCCA GGGTCTTCAC CTCCTCTATT AAGACAAAAT
16001  CTGCAGAAAT GACGATCACC ACCCAAGCAA GTCCTCCTGA GTCTGCATCG
16051  CACAGTACCC TTCCCTTGGA CACATCAACC ACACTTTCCC AGGGAGGGAC
16101  TCATTCAACT GTGACTCAGG GATTCCCATA CTCAGAGGTG ACCACTCTCA
16151  TGGGCATGGG TCCTGGGAAT GTGTCATGGA TGACAACTCC CCCTGTGGAA
16201  GAAACCAGCT CTGTGTCTTC CCTGATGTCT TCACCTGCCA TGACATCCCC
16251  TTCTCCTGTT TCCTCCACAT CACCACAGAG CATCCCCTCC TCTCCTCTTC
16301  CTGTGACTGC ACTTCCTACT TCTGTTCTGG TGACAACCAC AGATGTGTTG
16351  GGCACAACAA GCCCAGAGTC TGTAACCAGT TCACCTCCAA ATTTGAGCAG
16401  CATCACTCAT GAGAGACCGG CCACTTACAA AGACACTGCA CACACAGAAG
16451  CCGCCATGCA TCATTCCACA AACACCGCAG TGACCAATGT AGGGACTTCC
16501  GGGTCTGGAC ATAAATCACA ATCCTCTGTC CTAGCTGACT CAGAGACATC
16551  GAAAGCCACA CCTCTGATGA GTACCACCTC CACCCTGGGG GACACAAGTG
16601  TTTCCACATC AACTCCTAAT ATCTCTCAGA CTAACCAAAT TCAAACAGAG
16651  CCAACAGCAT CCCTGAGCCC TAGACTGAGG GAGAGCAGCA CGTCTGAGAA
16701  GACCAGCTCA ACAACAGAGA CAAATACTGC CTTTTCTTAT GTGCCCACAG
16751  GTGCTATTAC TCAGGCCTCC AGAACAGAAA TCTCCTCTAG CAGAACATCC
16801  ATCTCAGACC TTGATCGGCC CACAATAGCA CCCGACATCT CCACAGGAAT
16851  GATCACCAGG CTCTTCACCT CCCCCATCAT GACAAAATCT GCAGAAATGA
16901  CCGTCACCAC TCAAACAACT ACTCCTGGGG CTACATCACA GGGTATCCTT
16951  CCTTGGGACA CATCAACCAC ACTTTTCCAG GGAGGGACTC ATTCAACCGT
17001  GTCTCAGGGA TTCCCACACT CAGAGATAAC CACTCTTCGG AGCAGAACCC
17051  CTGGAGATGT GTCATGGATG ACAACTCCCC CTGTGGAAGA AACCAGCTCT
17101  GGGTTTTCCC TGATGTCACC TTCCATGACA TCCCCTTCTC CTGTTTCCTC
17151  CACATCACCA GAGAGCATCC CCTCCTCTCC TCTCCCTGTG ACTGCACTTC
17201  TTACTTCTGT TCTGGTGACA ACCACCAATG TATTGGGCAC AACAAGCCCA
17251  GAGACCGTAA CGAGTTCACC TCCAAATTTA AGCAGCCCCA CACAGGAGAG
17301  ACTGACCACT TACAAAGACA CTGCGCACAC AGAAGCCATG CATGCTTCCA
17351  TGCATACAAA CACTGCAGTG GCCAACGTCG GGACCTCCAT TTCTGGACAT
17401  GAATCACAAT CTTCTGTCCC AGCTGATTCA CACACATCCA AAGCCACATC
17451  TCCAATGGGT ATCACCTTCG CCATGGGGGA TACAAGTGTT TCTACATCAA
17501  CTCCTGCCTT CTTTGAGACT AGAATTCAGA CTGAATCAAC ATCCTCTTTG
17551  ATTCCTGGAT TAAGGGACAC CAGGACGTCT GAGGAGATCA ACACTGTGAC
```

TABLE 30-continued

Human cDNA of CA125
(SEQ ID NO: 314)

```
17601  AGAGACCAGC ACTGTCCTTT CAGAAGTGCC CACTACTACT ACTACTGAGG
17651  TCTCCAGGAC AGAAGTTATC ACTTCCAGCA GAACAACCAT CTCAGGGCCT
17701  GATCATTCCA AAATGTCACC CTACATCTCC ACAGAAACCA TCACCAGGCT
17751  CTCCACTTTT CCTTTTGTAA CAGGATCCAC AGAAATGGCC ATCACCAACC
17801  AAACAGGTCC TATAGGGACT ATCTCACAGG CTACCCTTAC CCTGGACACA
17851  TCAAGCACAG CTTCCTGGGA AGGGACTCAC TCACCTGTGA CTCAGAGATT
17901  TCCACACTCA GAGGAGACCA CTACTATGAG CAGAAGTACT AAGGGCGTGT
17951  CATGGCAAAG CCCTCCCTCT GTGGAAGAAA CCAGTTCTCC TTCTTCCCCA
18001  GTGCCTTTAC CTGCAATAAC CTCACATTCA TCTCTTTATT CCGCAGTATC
18051  AGGAAGTAGC CCCACTTCTG CTCTCCCTGT GACTTCCCTT CTCACCTCTG
18101  GCAGGAGGAA GACCATAGAC ATGTTGGACA CACACTCAGA ACTTGTGACC
18151  AGCTCCTTAC CAAGTGCAAG TAGCTTCTCA GGTGAGATAC TCACTTCTGA
18201  AGCCTCCACA AATACAGAGA CAATTCACTT TTCAGAGAAC ACAGCAGAAA
18251  CCAATATGGG GACCACCAAT TCTATGCATA AACTACATTC CTCTGTCTCA
18301  ATCCACTCCC AGCCATCCGG ACACACACCT CCAAAGGTTA CTGGATCTAT
18351  GATGGAGGAC GCTATTGTTT CCACATCAAC ACCTGGTTCT CCTGAGACTA
18401  AAAATGTTGA CAGAGACTCA ACATCCCCTC TGACTCCTGA ACTGAAAGAG
18451  GACAGCACCG CCCTGGTGAT GAACTCAACT ACAGAGTCAA ACACTGTTTT
18501  CTCCAGTGTG TCCCTGGATG CTGCTACTGA GGTCTCCAGG GCAGAAGTCA
18551  CCTACTATGA TCCTACATTC ATGCCAGCTT CTGCTCAGTC AACAAAGTCC
18601  CCAGACATTT CACCTGAAGC CAGCAGCAGT CATTCTAACT CTCCTCCCTT
18651  GACAATATCT ACACACAAGA CCATCGCCAC ACAAACAGGT CCTTCTGGGG
18701  TGACATCTCT TGGCCAACTG ACCCTGGACA CATCAACCAT AGCCACCTCA
18751  GCAGGAACTC CATCAGCCAG AACTCAGGAT TTTGTAGATT CAGAAACAAC
18801  CAGTGTCATG AACAATGATC TCAATGATGT GTTGAAGACA AGCCCTTTCT
18851  CTGCAGAAGA AGCCAACTCT CTCTCTTCTC AGGCACCTCT CCTTGTGACA
18901  ACCTCACCTT CTCCTGTAAC TTCCACATTG CAAGAGCACA GTACCTCCTC
18951  TCTTGTTTCT GTGACCTCAG TACCCACCCC TACACTGGCG AAGATCACAG
19001  ACATGGACAC AAACTTAGAA CCTGTGACTC GTTCACCTCA AAATTTAAGG
19051  AACACCTTGG CCACTTCAGA AGCCACCACA GATACACACA CAATGCATCC
19101  TTCTATAAAC ACAGCAATGG CCAATGTGGG GACCACCAGT TCACCAAATG
19151  AATTCTATTT TACTGTCTCA CCTGACTCAG ACCCATATAA AGCCACATCC
19201  GCAGTAGTTA TCACTTCCAC CTCGGGGGAC TCAATAGTTT CCACATCAAT
19251  GCCTAGATCC TCTGCGATGA AAAAGATTGA GTCTGAGACA ACTTTCTCCC
19301  TGATATTTAG ACTGAGGGAG ACTAGCACCT CCCAGAAAAT TGGCTCATCC
19351  TCAGACACAA GCACGGTCTT TGACAAAGCA TTCACTGCTG CTACTACTGA
19401  GGTCTCCAGA ACAGAACTCA CCTCCTCTAG CAGAACATCC ATCCAAGGCA
19451  CTGAAAAGCC CACAATGTCA CCGGACACCT CCACAAGATC TGTCACCATG
```

TABLE 30-continued

Human cDNA of CA125
(SEQ ID NO: 314)

```
19501  CTTTCTACTT TTGCTGGCCT GACAAAATCC GAAGAAAGGA CCATTGCCAC
19551  CCAAACAGGT CCTCATAGGG CGACATCACA GGGTACCCTT ACCTGGGACA
19601  CATCAATCAC AACCTCACAG GCAGGGACCC ACTCAGCTAT GACTCATGGA
19651  TTTTCACAAT TAGATTTGTC CACTCTTACG AGTAGAGTTC CTGAGTACAT
19701  ATCAGGGACA AGCCCACCCT CTGTGGAAAA AACCAGCTCT TCCTCTTCCC
19751  TTCTGTCTTT ACCAGCAATA ACCTCACCGT CCCCTGTACC TACTACATTA
19801  CCAGAAAGTA GGCCGTCTTC TCCTGTTCAT CTGACTTCAC TCCCCACCTC
19851  TGGCCTAGTG AAGACCACAG ATATGCTGGC ATCTGTGGCC AGTTTACCTC
19901  CAAACTTGGG CAGCACCTCA CATAAGATAC CGACTACTTC AGAAGACATT
19951  AAAGATACAG AGAAAATGTA TCCTTCCACA AACATAGCAG TAACCAATGT
20001  GGGGACCACC ACTTCTGAAA AGGAATCTTA TTCGTCTGTC CCAGCCTACT
20051  CAGAACCACC CAAAGTCACC TCTCCAATGG TTACCTCTTT CAACATAAGG
20101  GACACCATTG TTTCCACATC CATGCCTGGC TCCTCTGAGA TTACAAGGAT
20151  TGAGATGGAG TCAACATTCT CCGTGGCTCA TGGGCTGAAG GGAACCAGCA
20201  CCTCCCAGGA CCCCATCGTA TCCACAGAGA AAAGTGCTGT CCTTCACAAG
20251  TTGACCACTG GTGCTACTGA GACCTCTAGG ACAGAAGTTG CCTCTTCTAG
20301  AAGAACATCC ATTCCAGGCC CTGATCATTC CACAGAGTCA CCAGACATCT
20351  CCACTGAAGT GATCCCCAGC CTGCCTATCT CCCTTGGCAT TACAGAATCT
20401  TCAAATATGA CCATCATCAC TCGAACAGGT CCTCCTCTTG CTCTACATC
20451  ACAGGGCACA TTTACCTTGG ACACACCAAC TACATCCTCC AGGGCAGGAA
20501  CACACTCGAT GGCGACTCAG GAATTTCCAC ACTCAGAAAT GACCACTGTC
20551  ATGAACAAGG ACCCTGAGAT TCTATCATGG ACAATCCCTC CTTCTATAGA
20601  GAAAACCAGC TTCTCCTCTT CCCTGATGCC TTCACCAGCC ATGACTTCAC
20651  CTCCTGTTTC CTCAACATTA CCAAAGACCA TTCACACCAC TCCTTCTCCT
20701  ATGACCTCAC TGCTCACCCC TAGCCTAGTG ATGACCACAG ACACATTGGG
20751  CACAAGCCCA GAACCTACAA CCAGTTCACC TCCAAATTTG AGCAGTACCT
20801  CACATGTGAT ACTGACAACA GATGAAGACA CCACAGCTAT AGAAGCCATG
20851  CATCCTTCCA CAAGCACAGC AGCGACTAAT GTGGAAACCA CCTGTTCTGG
20901  ACATGGGTCA CAATCCTCTG TCCTAACTGA CTCAGAAAAA ACCAAGGCCA
20951  CAGCTCCAAT GGATACCACC TCCACCATGG GCATACAAC TGTTTCCACA
21001  TCAATGTCTG TTTCCTCTGA GACTACAAAA ATTAAGAGAG AGTCAACATA
21051  TTCCTTGACT CCTGGACTGA GAGAGACCAG CATTTCCCAA AATGCCAGCT
21101  TTTCCACTGA CACAAGTATT GTTCTTTCAG AAGTCCCCAC TGGTACTACT
21151  GCTGAGGTCT CCAGGACAGA AGTCACCTCC TCTGGTAGAA CATCCATCCC
21201  TGGCCCTTCT CAGTCCACAG TTTTGCCAGA ATATCCACA AGAACAATGA
21251  CAAGGCTCTT TGCCTCGCCC ACCATGACAG AATCAGCAGA AATGACCATC
21301  CCCACTCAAA CAGGTCCTTC TGGGTCTACC TCACAGGATA CCCTTACCTT
21351  GGACACATCC ACCACAAAGT CCCAGGCAAA GACTCATTCA ACTTTGACTC
21401  AGAGATTTCC ACACTCAGAG ATGACCACTC TCATGAGCAG AGGTCCTGGA
```

TABLE 30-continued

Human cDNA of CA125
(SEQ ID NO: 314)

```
21451  GATATGTCAT GGCAAAGCTC TCCCTCTCTG GAAAATCCCA GCTCTCTCCC
21501  TTCCCTGCTG TCTTTACCTG CCACAACCTC ACCTCCTCCC ATTTCCTCCA
21551  CATTACCAGT GACTATCTCC TCCTCTCCTC TTCCTGTGAC TTCACTTCTC
21601  ACCTCTAGCC CGGTAACGAC ACAGACATG TTACACACAA GCCCAGAACT
21651  TGTAACCAGT TCACCTCCAA AGCTGAGCCA CACTTCAGAT GAGAGACTGA
21701  CCACTGGCAA GGACACCACA AATACAGAAG CTGTGCATCC TTCCACAAAC
21751  ACAGCAGCGT CCAATGTGGA GATTCCCAGC TTTGGACATG AATCCCCTTC
21801  CTCTGCCTTA GCTGACTCAG AGACATCCAA AGCCACATCA CCAATGTTTA
21851  TTACCTCCAC CCAGGAGGAT ACAACTGTTG CCATATCAAC CCCTCACTTC
21901  TTGGAGACTA GCAGAATTCA GAAAGAGTCA ATTTCCTCCC TGAGCCCTAA
21951  ATTGAGGGAG ACAGGCAGTT CTGTGGAGAC AAGCTCAGCC ATAGAGACAA
22001  GTGCTGTCCT TTCTGAAGTG TCCATTGGTG CTACTACTGA GATCTCCAGG
22051  ACAGAAGTCA CCTCCTCTAG CAGAACATCC ATCTCTGGTT CTGCTGAGTC
22101  CACAATGTTG CCAGAAATAT CCACCACAGA AAAAATCATT AAGTTCCCTA
22151  CTTCCCCCAT CCTGGCAGAA TCATCAGAAA TGACCATCAA GACCCAAACA
22201  AGTCCTCCTG GGTCTACATC AGAGAGTACC TTTACATTAG ACACATCAAC
22251  CACTCCCTCC TTGGTAATAA CCCATTCGAC TATGACTCAG AGATTGCCAC
22301  ACTCAGAGAT AACCACTCTT GTGAGTAGAG GTGCTGGGGA TGTGCCACGG
22351  CCCAGCTCTC TCCCTGTGGA AGAAACAAGC CCTCCATCTT CCCAGCTGTC
22401  TTTATCTGCC ATGATCTCAC CTTCTCCTGT TTCTTCCACA TTACCAGCAA
22451  GTAGCCACTC CTCTTCTGCT TCTGTGACTT CACCTCTCAC ACCAGGCCAA
22501  GTGAAGACTA CTGAGGTGTT GGACGCAAGT GCAGAACCTG AAACCAGTTC
22551  ACCTCCAAGT TTGAGCAGCA CCTCAGTTGA ATACTGGCC ACCTCTGAAG
22601  TCACCACAGA TACGGAGAAA ATTCATCCTT TCCCAAACAC GGCAGTAACC
22651  AAAGTTGGAA CTTCCAGTTC TGGACATGAA TCCCCTTCCT CTGTCCTACC
22701  TGACTCAGAG ACAACCAAAG CCACATCGGC AATGGGTACC ATCTCCATTA
22751  TGGGGATAC AAGTGTTTCT ACATTAACTC CTGCCTTATC TAACACTAGG
22801  AAAATTCAGT CAGAGCCAGC TTCCTCACTG ACCACCAGAT TGAGGGAGAC
22851  CAGCACCTCT GAAGAGACCA GCTTAGCCAC AGAAGCAAAC ACTGTTCTTT
22901  CTAAAGTGTC CACTGGTGCT ACTACTGAGG TCTCCAGGAC AGAAGCCATC
22951  TCCTTTAGCA GAACATCCAT GTCAGGCCCT GAGCAGTCCA CAATGTCACA
23001  AGACATCTCC ATAGGAACCA TCCCCAGGAT TTCTGCCTCC TCTGTCCTGA
23051  CAGAATCTGC AAAAATGACC ATCACAACCC AAACAGGTCC TTCGGAGTCT
23101  ACACTAGAAA GTACCCTTAA TTTGAACACA GCAACCACAC CCTCTTGGGT
23151  GGAAACCCAC TCTATAGTAA TTCAGGGATT TCCACACCCA GAGATGACCA
23201  CTTCCATGGG CAGAGGTCCT GGAGGTGTGT CATGGCCTAG CCCTCCCTTT
23251  GTGAAAGAAA CCAGCCCTCC ATCCTCCCCG CTGTCTTTAC CTGCCGTGAC
23301  CTCACCTCAT CCTGTTTCCA CCACATTCCT AGCACATATC CCCCCCTCTC
```

TABLE 30-continued

Human cDNA of CA125
(SEQ ID NO: 314)

```
23351  CCCTTCCTGT GACTTCACTT CTCACCTCTG GCCCGGCGAC AACCACAGAT
23401  ATCTTGGGTA CAAGCACAGA ACCTGGAACC AGTTCATCTT CAAGTTTGAG
23451  CACCACCTCC CATGAGAGAC TGACCACTTA CAAAGACACT GCACATACAG
23501  AAGCCGTGCA TCCTTCCACA ACACAGGAG GGACCAATGT GGCAACCACC
23551  AGCTCTGGAT ATAAATCACA GTCCTCTGTC CTAGCTGACT CATCTCCAAT
23601  GTGTACCACC TCCACCATGG GGGATACAAG TGTTCTCACA TCAACTCCTG
23651  CCTTCCTTGA GACTAGGAGG ATTCAGACAG AGCTAGCTTC CTCCCTGACC
23701  CCTGGATTGA GGGAGTCCAG TGGCTCTGAA GGGACCAGCT CAGGCACCAA
23751  GATGAGCACT GTCCTCTCTA AAGTGCCCAC TGGTGCTACT ACTGAGATCT
23801  CCAAGGAAGA CGTCACCTCC ATCCCAGGTC CCGCTCAATC CACAATATCA
23851  CCAGACATCT CCACAAGAAC CGTCAGCTGG TTCTCTACAT CCCCTGTCAT
23901  GACAGAATCA GCAGAAATAA CCATGAACAC CCATACAAGT CCTTTAGGGG
23951  CCACAACACA AGGCACCAGT ACTTTGGCCA CGTCAAGCAC AACCTCTTTG
24001  ACAATGACAC ACTCAACTAT ATCTCAAGGA TTTTCACACT CACAGATGAG
24051  CACTCTTATG AGGAGGGGTC CTGAGGATGT ATCATGGATG AGCCCTCCCC
24101  TTCTGGAAAA AACTAGACCT TCCTTTTCTC TGATGTCTTC ACCAGCCACA
24151  ACTTCACCTT CTCCTGTTTC CTCCACATTA CCAGAGAGCA TCTCTTCCTC
24201  TCCTCTTCCT GTGACTTCAC TCCTCACGTC TGGCTTGGCA AAAACTACAG
24251  ATATGTTGCA CAAAAGCTCA GAACCTGTAA CCAACTCACC TGCAAATTTG
24301  AGCAGCACCT CAGTTGAAAT ACTGGCCACC TCTGAAGTCA CCACAGATAC
24351  AGAGAAAACT CATCCTTCTT CAAACAGAAC AGTGACCGAT GTGGGGACCT
24401  CCAGTTCTGG ACATGAATCC ACTTCCTTTG TCCTAGCTGA CTCACAGACA
24451  TCCAAAGTCA CATCTCCAAT GGTTATTACC TCCACCATGG AGGATACGAG
24501  TGTCTCCACA TCAACTCCTG GCTTTTTTGA GACTAGCAGA ATTCAGACAG
24551  AACCAACATC CTCCCTGACC CTTGGACTGA GAAAGACCAG CAGCTCTGAG
24601  GGGACCAGCT TAGCCACAGA GATGAGCACT GTCCTTTCTG GAGTGCCCAC
24651  TGGTGCCACT GCTGAAGTCT CCAGGACAGA AGTCACCTCC TCTAGCAGAA
24701  CATCCATCTC AGGCTTTGCT CAGCTCACAG TGTCACCAGA GACTTCCACA
24751  GAAACCATCA CCAGACTCCC TACCTCCAGC ATAATGACAG AATCAGCAGA
24801  AATGATGATC AAGACACAAA CAGATCCTCC TGGGTCTACA CCAGAGAGTA
24851  CTCATACTGT GGACATATCA ACAACACCCA ACTGGGTAGA AACCCACTCG
24901  ACTGTGACTC AGAGATTTTC ACACTCAGAG ATGACCACTC TTGTGAGCAG
24951  AAGCCCTGGT GATATGTTAT.GGCCTAGTCA ATCCTCTGTG GAAGAAACCA
25001  GCTCTGCCTC TTCCCTGCTG TCTCTGCCTG CCACGACCTC ACCTTCTCCT
25051  GTTTCCTCTA CATTAGTAGA GGATTTCCCT TCCGCTTCTC TTCCTGTGAC
25101  TTCTCTTCTC ACCCCTGGCC TGGTGATAAC CACAGACAGG ATGGGCATAA
25151  GCAGAGAACC TGGAACCAGT TCCACTTCAA ATTTGAGCAG CACCTCCCAT
25201  GAGAGACTGA CCACTTTGGA AGACACTGTA GATACAGAAG ACATGCAGCC
25251  TTCCACACAC ACAGCAGTGA CCAACGTGAG GACCTCCATT TCTGGACATG
```

TABLE 30-continued

Human cDNA of CA125
(SEQ ID NO: 314)

```
25301 AATCACAATC TTCTGTCCTA TCTGACTCAG AGACACCCAA AGCCACATCT
25351 CCAATGGGTA CCACCTACAC CATGGGGGAA ACGAGTGTTT CCATATCCAC
25401 TTCTGACTTC TTTGAGACCA GCAGAATTCA GATAGAACCA ACATCCTCCC
25451 TGACTTCTGG ATTGAGGGAG ACCAGCAGCT CTGAGAGGAT CAGCTCAGCC
25501 ACAGAGGGAA GCACTGTCCT TTCTGAAGTG CCCAGTGGTG CTACCACTGA
25551 GGTCTCCAGG ACAGAAGTGA TATCCTCTAG GGAACATCC ATGTCAGGGC
25601 CTGATCAGTT CACCATATCA CCAGACATCT CTACTGAAGC GATCACCAGG
25651 CTTTCTACTT CCCCCATTAT GACAGAATCA GCAGAAAGTG CCATCACTAT
25701 TGAGACAGGT TCTCCTGGGG CTACATCAGA GGGTACCCTC ACCTTGGACA
25751 CCTCAACAAC AACCTTTTGG TCAGGGACCC ACTCAACTGC ATCTCCAGGA
25801 TTTTCACACT CAGAGATGAC CACTCTTATG AGTAGAACTC CTGGAGATGT
25851 GCCATGGCCG AGCCTTCCCT CTGTGGAAGA AGCCAGCTCT GTCTCTTCCT
25901 CACTGTCTTC ACCTGCCATG ACCTCAACTT CTTTTTTCTC CGCATTACCA
25951 GAGAGCATCT CCTCCTCTCC TCATCCTGTG ACTGCACTTC TCACCCTTGG
26001 CCCAGTGAAG ACCACAGACA TGTTGCGCAC AAGCTCAGAA CCTGAAACCA
26051 GTTCACCTCC AAATTTGAGC AGCACCTCAG CTGAAATATT AGCCACGTCT
26101 GAAGTCACCA AAGATAGAGA GAAAATTCAT CCCTCCTCAA ACACACCTGT
26151 AGTCAATGTA GGGACTGTGA TTTATAAACA TCTATCCCCT TCCTCTGTTT
26201 TGGCTGACTT AGTGACAACA AAACCCACAT CTCCAATGGC TACCACCTCC
26251 ACTCTGGGGA ATACAAGTGT TTCCACATCA ACTCCTGCCT TCCCAGAAAC
26301 TATGATGACA CAGCCAACTT CCTCCCTGAC TTCTGGATTA AGGGAGATCA
26351 GTACCTCTCA AGAGACCAGC TCAGCAACAG AGAGAAGTGC TTCTCTTTCT
26401 GGAATGCCCA CTGGTGCTAC TACTAAGGTC TCCAGAACAG AAGCCCTCTC
26451 CTTAGGCAGA ACATCCACCC CAGGTCCTGC TCAATCCACA ATATCACCAG
26501 AAATCTCCAC GGAAACCATC ACTAGAATTT CTACTCCCCT CACCACGACA
26551 GGATCAGCAG AAATGACCAT CACCCCCAAA ACAGGTCATT CTGGGGCATC
26601 CTCACAAGGT ACCTTTACCT TGGACACATC AAGCAGAGCC TCCTGGCCAG
26651 GAACTCACTC AGCTGCAACT CACAGATCTC CACACTCAGG GATGACCACT
26701 CCTATGAGCA GAGGTCCTGA GGATGTGTCA TGGCCAAGCC GCCCATCAGT
26751 GGAAAAAACT AGCCCTCCAT CTTCCCTGGT GTCTTTATCT GCAGTAACCT
26801 CACCTTCGCC ACTTTATTCC ACACCATCTG AGAGTAGCCA CTCATCTCCT
26851 CTCCGGGTGA CTTCTCTTTT CACCCCTGTC ATGATGAAGA CCACAGACAT
26901 GTTGGACACA AGCTTGGAAC CTGTGACCAC TTCACCTCCC AGTATGAATA
26951 TCACCTCAGA TGAGAGTCTG GCCACTTCTA AAGCCACCAT GGAGACAGAG
27001 GCAATTCAGC TTTCAGAAAA CACAGCTGTG ACTCAGATGG CACCATCAG
27051 CGCTAGACAA GAATTCTATT CCTCTTATCC AGGCCTCCCA GAGCCATCCA
27101 AAGTGACATC TCCAGTGGTC ACCTCTTCCA CCATAAAAGA CATTGTTTCT
27151 ACAACCATAC CTGCTTCCTC TGAGATAACA AGAATTGAGA TGGAGTCAAC
```

TABLE 30-continued

Human cDNA of CA125
(SEQ ID NO: 314)

```
27201  ATCCACCCTG ACCCCCACAC CAAGGGAGAC CAGCACCTCC CAGGAGATCC
27251  ACTCAGCCAC AAAGCCAAGC ACTGTTCCTT ACAAGGCACT CACTAGTGCC
27301  ACGATTGAGG ACTCCATGAC ACAAGTCATG.TCCTCTAGCA GAGGACCTAG
27351  CCCTGATCAG TCCACAATGT CACAAGACAT ATCCAGTGAA GTGATCACCA
27401  GGCTCTCTAC CTCCCCCATC AAGGCAGAAT CTACAGAAAT GACCATTACC
27451  ACCCAAACAG GTTCTCCTGG GGCTACATCA AGGGGTACCC TTACCTTGGA
27501  CACTTCAACA ACTTTTATGT CAGGGACCCA CTCAACTGCA TCTCAAGGAT
27551  TTTCACACTC ACAGATGACC GCTCTTATGA GTAGAACTCC TGGAGATGTG
27601  CCATGGCTAA GCCATCCCTC TGTGGAAGAA GCCAGCTCTG CCTCTTTCTC
27651  ACTGTCTTCA CCTGTCATGA CCTCATCTTC TCCCGTTTCT TCCACATTAC
27701  CAGACAGCAT CCACTCTTCT TCGCTTCCTG TGACATCACT TCTCACCTCA
27751  GGGCTGGTGA AGACCACAGA GCTGTTGGGC ACAAGCTCAG AACCTGAAAC
27801  CAGTTCACCC CCAAATTTGA GCAGCACCTC AGCTGAAATA CTGGCCACCA
27851  CTGAAGTCAC TACAGATACA GAGAAACTGG AGATGACCAA TGTGGTAACC
27901  TCAGGTTATA CACATGAATC TCCTTCCTCT GTCCTAGCTG ACTCAGTGAC
27951  AACAAAGGCC ACATCTTCAA TGGGTATCAC CTACCCCACA GGAGATACAA
28001  ATGTTCTCAC ATCAACCCCT GCCTTCTCTG ACACCAGTAG GATTCAAACA
28051  AAGTCAAAGC TCTCACTGAC TCCTGGGTTG ATGGAGACCA GCATCTCTGA
28101  AGAGACCAGC TCTGCCACAG AAAAAAGCAC TGTCCTTTCT AGTGTGCCCA
28151  CTGGTGCTAC TACTGAGGTC TCCAGGACAG AAGCCATCTC TTCTAGCAGA
28201  ACATCCATCC CAGGCCCTGC TCAATCCACA ATGTCATCAG ACACCTCCAT
28251  GGAAACCATC ACTAGAATTT CTACCCCCCT CACAAGGAAA GAATCAACAG
28301  ACATGGCCAT CACCCCCAAA ACAGGTCCTT CTGGGGCTAC CTCGCAGGGT
28351  ACCTTTACCT TGGACTCATC AAGCACAGCC TCCTGGCCAG GAACTCACTC
28401  AGCTACAACT CAGAGATTTC ACAGTCAGT GGTGACAACT CCTATGAGCA
28451  GAGGTCCTGA GGATGTGTCA TGGCCAAGCC CGCTGTCTGT GGAAAAAAAC
28501  AGCCCTCCAT CTTCCCTGGT ATCTTCATCT TCAGTAACCT CACCTTCGCC
28551  ACTTTATTCC ACACCATCTG GGAGTAGCCA CTCCTCTCCT GTCCCTGTCA
28601  CTTCTCTTTT CACCTCTATC ATGATGAAGG CCACAGACAT GTTGGATGCA
28651  AGTTTGGAAC CTGAGACCAC TTCAGCTCCC AATATGAATA TCACCTCAGA
28701  TGAGAGTCTG GCCACTTCTA AAGCCACCAC GGAGACAGAG GCAATTCACG
28751  TTTTTGAAAA TACAGCAGCG TCCCATGTGG AAACCACCAG TGCTACAGAG
28801  GAACTCTATT CCTCTTCCCC AGGCTTCTCA GAGCCAACAA AAGTGATATC
28851  TCCAGTGGTC ACCTCTTCCT CTATAAGAGA CAACATGGTT TCCACAACAA
28901  TGCCTGGCTC CTCTGGCATT ACAAGGATTG AGATAGAGTC AATGTCATCT
28951  CTGACCCCTG GACTGAGGGA GACCAGAACC TCCCAGGACA TCACCTCATC
29001  CACAGAGACA AGCACTGTCC TTTACAAGAT GTCCTCTGGT GCCACTCCTG
29051  AGGTCTCCAG GACAGAAGTT ATGCCCTCTA GCAGAACATC CATTCCTGGC
29101  CCTGCTCAGT CCACAATGTC ACTAGACATC TCCGATGAAG TTGTCACCAG
```

TABLE 30-continued

Human cDNA of CA125
(SEQ ID NO: 314)

```
29151  GCTGTCTACC TCTCCCATCA TGACAGAATC TGCAGAAATA ACCATCACCA
29201  CCCAAACAGG TTATTCTCTG GCTACATCCC AGGTTACCCT TCCCTTGGGC
29251  ACCTCAATGA CCTTTTTGTC AGGGACCCAC TCAACTATGT CTCAAGGACT
29301  TTCACACTCA GAGATGACCA ATCTTATGAG CAGGGGTCCT GAAAGTCTGT
29351  CATGGACGAG CCCTCGCTTT GTGGAAACAA CTAGATCTTC CTCTTCTCTG
29401  ACATCATTAC CTCTCACGAC CTCACTTTCT CCTGTGTCCT CCACATTACT
29451  AGACAGTAGC CCCTCCTCTC CTCTTCCTGT GACTTCACTT ATCCTCCCAG
29501  GCCTGGTGAA GACTACAGAA GTGTTGGATA CAAGCTCAGA GCCTAAAACC
29551  AGTTCATCTC CAAATTTGAG CAGCACCTCA GTTGAAATAC CGGCCACCTC
22960  TGAAATCATG ACAGATACAG AGAAAATTCA TCCTTCCTCA AACACAGCGG
29651  TGGCCAAAGT GAGGACCTCC AGTTCTGTTC ATGAATCTCA TTCCTCTGTC
29701  CTAGCTGACT CAGAAACAAC CATAACCATA CCTTCAATGG GTATCACCTC
29751  CGCTGTGGAC GATACCACTG TTTTCACATC AAATCCTGCC TTCTCTGAGA
29801  CTAGGAGGAT TCCGACAGAG CCAACATTCT CATTGACTCC TGGATTCAGG
29851  GAGACTAGCA CCTCTGAAGA GACCACCTCA ATCACAGAAA CAAGTGCAGT
29901  CCTTTATGGA GTGCCCACTA GTGCTACTAC TGAAGTCTCC ATGACAGAAA
29951  TCATGTCCTC TAATAGAACA CACATCCCTG ACTCTGATCA GTCCACGATG
30001  TCTCCAGACA TCATCACTGA AGTGATCACC AGGCTCTCTT CCTCATCCAT
30051  GATGTCAGAA TCAACACAAA TGACCATCAC CACCCAAAAA AGTTCTCCTG
30101  GGGCTACAGC ACAGAGTACT CTTACCTTGG CCACAACAAC AGCCCCCTTG
30151  GCAAGGACCC ACTCAACTGT TCCTCCTAGA TTTTTACACT CAGAGATGAC
30201  AACTCTTATG AGTAGGAGTC CTGAAAATCC ATCATGGAAG AGCTCTCCCT
30251  TTGTGGAAAA AACTAGCTCT TCATCTTCTC TGTTGTCCTT ACCTGTCACG
30301  ACCTCACCTT CTGTTTCTTC CACATTACCG CAGAGTATCC CTTCCTCCTC
30351  TTTTTCTGTG ACTTCACTCC TCACCCCAGG CATGGTGAAG ACTACAGACA
30401  CAAGCACAGA ACCTGGAACC AGTTTATCTC CAAATCTGAG TGGCACCTCA
30451  GTTGAAATAC TGGCTGCCTC TGAAGTCACC ACAGATACAG AGAAAATTCA
30501  TCCTTCTTCA AGCATGGCAG TGACCAATGT GGGAACCACC AGTTCTGGAC
30551  ATGAACTATA TTCCTCTGTT TCAATCCACT CGGAGCCATC CAAGGCTACA
30601  TACCCAGTGG GTACTCCCTC TTCCATGGCT GAAACCTCTA TTTCCACATC
30651  AATGCCTGCT AATTTTGAGA CCACAGGATT TGAGGCTGAG CCATTTCTC
30701  ATTTGACTTC TGGATTTAGG AAGACAAACA TGTCCCTGGA CACCAGCTCA
30751  GTCACACCAA CAAATACACC TTCTTCTCCT GGGTCCACTC ACCTTTTACA
30801  GAGTTCCAAG ACTGATTTCA CCTCTTCTGC AAAAACATCA TCCCCAGACT
30851  GGCCTCCAGC CTCACAGTAT ACTGAAATTC CAGTGGACAT AATCACCCCC
30901  TTTAATGCTT CTCCATCTAT TACGGAGTCC ACTGGGATAA CCTCCTTCCC
30951  AGAATCCAGG TTTACTATGT CTGTAACAGA AAGTACTCAT CATCTGAGTA
31001  CAGATTTGCT GCCTTCAGCT GAGACTATTT CCACTGGCAC AGTGATGCCT
```

TABLE 30-continued

Human cDNA of CA125
(SEQ ID NO: 314)

```
31051  TCTCTATCAG AGGCCATGAC TTCATTTGCC ACCACTGGAG TTCCACGAGC
31101  CATCTCAGGT TCAGGTAGTC CATTCTCTAG GACAGAGTCA GGCCCTGGGG
31151  ATGCTACTCT GTCCACCATT GCAGAGAGCC TGCCTTCATC CACTCCTGTG
31201  CCATTCTCCT CTTCAACCTT CACTACCACT GATTCTTCAA CCATCCCAGC
31251  CCTCCATGAG ATAACTTCCT CTTCAGCTAC CCCATATAGA GTGGACACCA
31301  GTCTTGGGAC AGAGAGCAGC ACTACTGAAG GACGCTTGGT TATGGTCAGT
31351  ACTTTGGACA CTTCAAGCCA ACCAGGCAGG ACATCTTCAA CACCCATTTT
31401  GGATACCAGA ATGACAGAGA GCGTTGAGCT GGGAACAGTG ACAAGTGCTT
31451  ATCAAGTTCC TTCACTCTCA ACACGGTTGA CAAGAACTGA TGGCATTATG
31501  GAACACATCA CAAAATACC CAATGAAGCA GCACACAGAG GTACCATAAG
31551  ACCAGTCAAA GGCCCTCAGA CATCCACTTC GCCTGCCAGT CCTAAAGGAC
31601  TACACACAGG AGGGACAAAA AGAATGGAGA CCACCACCAC AGCTTTGAAG
31651  ACCACCACCA CAGCTTTGAA GACCACTTCC AGAGCCACCT TGACCACCAG
31701  TGTCTATACT CCCACTTTGG GAACACTGAC TCCCCTCAAT GCATCAAGGC
31751  AAATGGCCAG CACAATCCTC ACAGAAATGA TGATCACAAC CCCATATGTT
31801  TTCCCTGATG TTCCAGAAAC GACATCCTCA TTGGCTACCA GCCTGGGAGC
31851  AGAAACCAGC ACAGCTCTTC CCAGGACAAC CCCATCTGTT CTCAATAGAG
31901  AATCAGAGAC CACAGCCTCA CTGGTCTCTC GTTCTGGGGC AGAGAGAAGT
31951  CCGGTTATTC AAACTCTAGA TGTTTCTTCT AGTGAGCCAG ATACAACAGC
32001  TTCATGGGTT ATCCATCCTG CAGAGACCAT CCCAACTGTT TCCAAGACAA
32051  CCCCCAATTT TTTCCACAGT GAATTAGACA CTGTATCTTC CACAGCCACC
32101  AGTCATGGGG CAGACGTCAG CTCAGCCATT CCAACAAATA TCTCACCTAG
32151  TGAACTAGAT GCACTGACCC CACTGGTCAC TATTTCGGGG ACAGATACTA
32201  GTACAACATT CCCAACACTG ACTAAGTCCC CACATGAAAC AGAGACAAGA
32251  ACCACATGGC TCACTCATCC TGCAGAGACC AGCTCAACTA TTCCCAGAAC
32301  AATCCCCAAT TTTTCTCATC ATGAATCAGA TGCCACACCT TCAATAGCCA
32351  CCAGTCCTGG GGCAGAAACC AGTTCAGCTA TTCCAATTAT GACTGTCTCA
32401  CCTGGTGCAG AAGATCTGGT GACCTCACAG GTCACTAGTT CTGGGACAGA
32451  CAGAAATATG ACTATTCCAA CTTTGACTCT TTCTCCTGGT GAACCAAAGA
32501  CGATAGCCTC ATTAGTCACC CATCCTGAAG CACAGACAAG TTCGGCCATT
32551  CCAACTTCAA CTATCTCGCC TGCTGTATCA CGGTTGGTGA CCTCAATGGT
32601  CACCAGTTTG GCGGCAAAGA CAAGTACAAC TAATCGAGCT CTGACAAACT
32651  CCCCTGGTGA ACCAGCTACA ACAGTTTCAT TGGTCACGCA TCCTGCACAG
32701  ACCAGCCCAA CAGTTCCCTG GACAACTTCC ATTTTTTTCC ATAGTAAATC
32751  AGACACCACA CCTTCAATGA CCACCAGTCA TGGGGCAGAA TCCAGTTCAG
32801  CTGTTCCAAC TCCAACTGTT TCAACTGAGG TACCAGGAGT AGTGACCCCT
32851  TTGGTCACCA GTTCTAGGGC AGTGATCAGT ACAACTATTC CAATTCTGAC
32901  TCTTTCTCCT GGTGAACCAG AGACCACACC TTCAATGGCC ACCAGTCATG
32951  GGGAAGAAGC CAGTTCTGCT ATTCCAACTC CAACTGTTTC ACCTGGGGTA
```

TABLE 30-continued

Human cDNA of CA125
(SEQ ID NO: 314)

```
33001 CCAGGAGTGG TGACCTCTCT GGTCACTAGT TCTAGGGCAG TGACTAGTAC
33051 AACTATTCCA ATTCTGACTT TTTCTCTTGG TGAACCAGAG ACCACACCTT
33101 CAATGGCCAC CAGTCATGGG ACAGAAGCTG GCTCAGCTGT TCCAACTGTT
33151 TTACCTGAGG TACCAGGAAT GGTGACCTCT CTGGTTGCTA GTTCTAGGGC
33201 AGTAACCAGT ACAACTCTTC CAACTCTGAC TCTTTCTCCT GGTGAACCAG
33251 AGACCACACC TTCAATGGCC ACCAGTCATG GGGCAGAAGC CAGCTCAACT
33301 GTTCCAACTG TTTCACCTGA GGTACCAGGA GTGGTGACCT CTCTGGTCAC
33351 TAGTTCTAGT GGAGTAAACA GTACAAGTAT TCCAACTCTG ATTCTTTCTC
33401 CTGGTGAACT AGAAACCACA CCTTCAATGG CCACCAGTCA TGGGGCAGAA
33451 GCCAGCTCAG CTGTTCCAAC TCCAACTGTT TCACCTGGGG TATCAGGAGT
33501 GGTGACCCCT CTGGTCACTA GTTCCAGGGC AGTGACCAGT ACAACTATTC
33551 CAATTCTAAC TCTTTCTTCT AGTGAGCCAG AGACCACACC TTCAATGGCC
33601 ACCAGTCATG GGGTAGAAGC CAGCTCAGCT GTTCTAACTG TTTCACCTGA
33651 GGTACCAGGA ATGGTGACCT CTCTGGTCAC TAGTTCTAGA GCAGTAACCA
33701 GTACAACTAT TCCAACTCTG ACTATTTCTT CTGATGAACC AGAGACCACA
33751 ACTTCATTGG TCACCCATTC TGAGGCAAAG ATGATTTCAG CCATTCCAAC
33801 TTTAGCTGTC TCCCCTACTG TACAAGGGCT GGTGACTTCA CTGGTCACTA
33851 GTTCTGGGTC AGAGACCAGT GCGTTTTCAA ATCTAACTGT TGCCTCAAGT
33901 CAACCAGAGA CCATAGACTC ATGGGTCGCT CATCCTGGGA CAGAAGCAAG
33951 TTCTGTTGTT CCAACTTTGA CTGTCTCCAC TGGTGAGCCG TTTACAAATA
34001 TCTCATTGGT CACCCATCCT GCAGAGAGTA GCTCAACTCT TCCCAGGACA
34051 ACCTCAAGGT TTTCCCACAG TGAATTAGAC ACTATGCCTT CTACAGTCAC
34101 CAGTCCTGAG GCAGAATCCA GCTCAGCCAT TTCAACTACT ATTTCACCTG
34151 GTATACCAGG TGTGCTGACA TCACTGGTCA CTAGCTCTGG GAGAGACATC
34201 AGTGCAACTT TTCCAACAGT GCCTGAGTCC CCACATGAAT CAGAGGCAAC
34251 AGCCTCATGG GTTACTCATC CTGCAGTCAC CAGCACAACA GTTCCCAGGA
34301 CAACCCCTAA TTATTCTCAT AGTGAACCAG ACACCACACC ATCAATAGCC
34351 ACCAGTCCTG GGCAGAAGC CACTTCAGAT TTTCCAACAA TAACTGTCTC
34401 ACCTGATGTA CCAGATATGG TAACCTCACA GGTCACTAGT TCTGGGACAG
34451 ACACCAGTAT AACTATTCCA ACTCTGACTC TTTCTTCTGG TGAGCCAGAG
34501 ACCACAACCT CATTTATCAC CTATTCTGAG ACACACACAA GTTCAGCCAT
34551 TCCAACTCTC CCTGTCTCCC CTGGTGCATC AAAGATGCTG ACCTCACTGG
34601 TCATCAGTTC TGGGACAGAC AGCACTACAA CTTTCCCAAC ACTGACGGAG
34651 ACCCCATATG AACCAGAGAC AACAGCCATA CAGCTCATTC ATCCTGCAGA
34701 GACCAACACA ATGGTTCCCA AGACAACTCC CAAGTTTTCC CATAGTAAGT
34751 CAGACACCAC ACTCCCAGTA GCCATCACCA GTCCTGGGCC AGAAGCCAGT
34801 TCAGCTGTTT CAACGACAAC TATCTCACCT GATATGTCAG ATCTGGTGAC
34851 CTCACTGGTC CCTAGTTCTG GGACAGACAC CAGTACAACC TTCCCAACAT
```

TABLE 30-continued

Human cDNA of CA125
(SEQ ID NO: 314)

```
34901  TGAGTGAGAC CCCATATGAA CCAGAGACTA CAGTCACGTG GCTCACTCAT
34951  CCTGCAGAAA CCAGCACAAC GGTTTCTGGG ACAATTCCCA ACTTTTCCCA
35001  TAGGGGATCA GACACTGCAC CCTCAATGGT CACCAGTCCT GGAGTAGACA
35051  CGAGGTCAGG TGTTCCAACT ACAACCATCC CACCCAGTAT ACCAGGGGTA
35101  GTGACCTCAC AGGTCACTAG TTCTGCAACA GACACTAGTA CAGCTATTCC
35151  AACTTTGACT CCTTCTCCTG GTGAACCAGA GACCCACAGCC TCATCAGCTA
35201  CCCATCCTGG GACACAGACT GGCTTCACTG TTCCAATTCG GACTGTTCCC
35251  TCTAGTGAGC CAGATACAAT GGCTTCCTGG GTCACTCATC CTCCACAGAC
35301  CAGCACACCT GTTTCCAGAA CAACCTCCAG TTTTTCCCAT AGTAGTCCAG
35351  ATGCCACACC TGTAATGGCC ACCAGTCCTA GGACAGAAGC CAGTTCAGCT
35401  GTACTGACAA CAATCTCACC TGGTGCACCA GAGATGGTGA CTTCACAGAT
35451  CACTAGTTCT GGGGCAGCAA CCAGTACAAC TGTTCCAACT TTGACTCATT
35501  CTCCTGGTAT GCCAGAGACC ACAGCCTTAT TGAGCACCCA TCCCAGAACA
35551  GGGACAAGTA AAACATTTCC TGCTTCAACT GTGTTTCCTC AAGTATCAGA
35601  GACCACAGCC TCACTCACCA TTAGACCTGG TGCAGAGACT AGCACAGCTC
35651  TCCCAACTCA GACAACATCC TCTCTCTTCA CCCTACTTGT AACTGGAACC
35701  AGCAGAGTTG ATCTAAGTCC AACTGCTTCA CCTGGTGTTT CTGCAAAAAC
35751  AGCCCCACTT TCCACCCATC CAGGGACAGA GACCAGCACA ATGATTCCAA
35801  CTTCAACTCT TTCCCTTGGT TTACTAGAGA CTACAGGCTT ACTGGCCACC
35851  AGCTCTTCAG CAGAGACCAG CACGAGTACT CTAACTCTGA CTGTTTCCCC
35901  TGCTGTCTCT GGGCTTTCCA GTGCCTCTAT AACAACTGAT AAGCCCCAAA
35951  CTGTGACCTC CTGGAACACA GAAACCTCAC CATCTGTAAC TTCAGTTGGA
36001  CCCCCAGAAT TTTCCAGGAC TGTCACAGGC ACCACTATGA CCTTGATACC
36051  ATCAGAGATG CCAACACCAC CTAAAACCAG TCATGGAGAA GGAGTGAGTC
36101  CAACCACTAT CTTGAGAACT ACAATGGTTG AAGCCACTAA TTTAGCTACC
36151  ACAGGTTCCA GTCCCACTGT GGCCAAGACA ACAACCACCT TCAATACACT
36201  GGCTGGAAGC CTCTTTACTC CTCTGACCAC ACCTGGGATG TCCACCTTGG
36251  CCTCTGAGAG TGTGACCTCA AGAACAAGTT ATAACCATCG GTCCTGGATC
36301  TCCACCACCA GCAGTTATAA CCGTCGGTAC TGGACCCCTG CCACCAGCAC
36351  TCCAGTGACT TCTACATTCT CCCCAGGGAT TTCCACATCC TCCATCCCCA
36401  GCTCCACAGC AGCCACAGTC CCATTCATGG TGCCATTCAC CCTCAACTTC
36451  ACCATCACCA ACCTGCAGTA CGAGGAGGAC ATGCGGCACC CTGGTTCCAG
36501  GAAGTTCAAC GCCACAGAGA GAGAACTGCA GGGTCTGCTC AAACCCTTGT
36551  TCAGGAATAG CAGTCTGGAA TACCTCTATT CAGGCTGCAG ACTAGCCTCA
36601  CTCAGGCCAG AGAAGGATAG CTCAGCCATG GCAGTGGATG CCATCTGCAC
36651  ACATCGCCCT GACCCTGAAG ACCTCGGACT GGACAGAGAG CGACTGTACT
36701  GGGAGCTGAG CAATCTGACA AATGGCATCC AGGAGCTGGG CCCCTACACC
36751  CTGGACCGGA ACAGTCTCTA TGTCAATGGT TTCACCCATC GAAGCTCTAT
36801  GCCCACCACC AGCACTCCTG GGACCTCCAC AGTGGATGTG GGAACCTCAG
```

TABLE 30-continued

Human cDNA of CA125
(SEQ ID NO: 314)

```
36851  GGACTCCATC CTCCAGCCCC AGCCCCACGG CTGCTGGCCC TCTCCTGATG

36901  CCGTTCACCC TCAACTTCAC CATCACCAAC CTGCAGTACG AGGAGGACAT

36951  GCGTCGCACT GGCTCCAGGA AGTTCAACAC CATGGAGAGT GTCCTGCAGG

37001  GTCTGCTCAA GCCCTTGTTC AAGAACACCA GTGTTGGCCC TCTGTACTCT

37051  GGCTGCAGAT TGACCTTGCT CAGGCCCGAG AAAGATGGGG CAGCCACTGG

37101  AGTGGATGCC ATCTGCACCC ACCGCCTTGA CCCCAAAAGC CCTGGACTCA

37151  ACAGGGAGCA GCTGTACTGG GAGCTAAGCA AACTGACCAA TGACATTGAA

37201  GAGCTGGGCC CCTACACCCT GGACAGGAAC AGTCTCTATG TCAATGGTTT

37251  CACCCATCAG AGCTCTGTGT CCACCACCAG CACTCCTGGG ACCTCCACAG

37301  TGGATCTCAG AACCTCAGGG ACTCCATCCT CCCTCTCCAG CCCCACAATT

37351  ATGGCTGCTG GCCCTCTCCT GGTACCATTC ACCCTCAACT TCACCATCAC

37401  CAACCTGCAG TATGGGGAGG ACATGGGTCA CCCTGGCTCC AGGAAGTTCA

37451  ACACCACAGA GAGGGTCCTG CAGGGTCTGC TTGGTCCCAT ATTCAAGAAC

37501  ACCAGTGTTG GCCCTCTGTA CTCTGGCTGC AGACTGACCT CTCTCAGGTC

37551  TGAGAAGGAT GGAGCAGCCA CTGGAGTGGA TGCCATCTGC ATCCATCATC

37601  TTGACCCCAA AAGCCCTGGA CTCAACAGAG AGCGGCTGTA CTGGGAGCTG

37651  AGCCAACTGA CCAATGGCAT CAAAGAGCTG GGCCCCTACA CCCTGGACAG

37701  GAACAGTCTC TATGTCAATG GTTTCACCCA TCGGACCTCT GTGCCCACCA

37751  CCAGCACTCC TGGGACCTCC ACAGTGGACC TTGGAACCTC AGGGACTCCA

37801  TTCTCCCTCC CAAGCCCCGC AACTGCTGGC CCTCTCCTGG TGCTGTTCAC

37851  CCTCAACTTC ACCATCACCA ACCTGAAGTA TGAGGAGGAC ATGCATCGCC

37901  CTGGCTCCAG GAAGTTCAAC ACCACTGAGA GGGTCCTGCA GACTCTGCTT

37951  GGTCCTATGT TCAAGAACAC CAGTGTTGGC CTTCTGTACT CTGGCTGCAG

38001  ACTGACCTTG CTCAGGTCCG AGAAGGATGG AGCAGCCACT GGAGTGGATG

38051  CCATCTGCAC CCACCGTCTT GACCCCAAAA GCCCTGGACT GGACAGAGAG

38101  CAGCTATACT GGGAGCTGAG CCAGCTGACC AATGGCATCA AGAGCTGGG

38151  CCCCTACACC CTGGACAGGA ACAGTCTCTA TGTCAATGGT TTCACCCATT

38201  GGATCCCTGT GCCCACCAGC AGCACTCCTG GGACCTCCAC AGTGGACCTT

38251  GGGTCAGGGA CTCCATCCTC CCTCCCCAGC CCCACAGCTG CTGGCCCTCT

38301  CCTGGTGCCA TTCACCCTCA ACTTCACCAT CACCAACCTG CAGTACGAGG

38351  AGGACATGCA TCACCCAGGC TCCAGGAAGT TCAACACCAC GGAGCGGGTC

38401  CTGCAGGGTC TGCTTGGTCC CATGTTCAAG AACACCAGTG TCGGCCTTCT

38451  GTACTCTGGC TGCAGACTGA CCTTGCTCAG GTCCGAGAAG GATGGAGCAG

38501  CCACTGGAGT GGATGCCATC TGCACCCACC GTCTTGACCC CAAAAGCCCT

38551  GGAGTGGACA GGGAGCAGCT ATACTGGGAG CTGAGCCAGC TGACCAATGG

38601  CATCAAAGAG CTGGGTCCCT ACACCCTGGA CAGAAACAGT CTCTATGTCA

38651  ATGGTTTCAC CCATCAGACC TCTGCGCCCA ACACCAGCAC TCCTGGGACC

38701  TCCACAGTGG ACCTTGGGAC CTCAGGGACT CCATCCTCCC TCCCCAGCCC
```

TABLE 30-continued

Human cDNA of CA125
(SEQ ID NO: 314)

```
38751  TACATCNGCT GGCCCTCTCC TGGTNCCNTT CACCCTCAAC TTCACCATCA
38801  CCAACCTGCA GTACGAGGAG GACATGCCGC ACCCNGGNTC CAGGAAGTTC
38851  AACACCACNG AGAGGGTNCT GCAGGGTCTG CTNAAGCCCC TNTTCAAGAG
38901  CACCAGTGTT GGCCCTCTGT ACTCTGGCTG CAGACTGACC TTGCTCAGGT
38951  CCGAGAAGGA TGGAGCAGCC ACTGGAGTGG ATGCCATCTG CACCCACCGT
39001  CTTGACCCCA AAAGAGCTGG AGTGGACAGG GAGCAGCTAT ACTGGGAGCT
39051  GAGCCAGCTG ACCAATGGCA TCAAAGAGCT GGGTCCCTAC ACCCTGGACA
39101  GAAACAGTCT CTATGTCAAT GGTTTCACCC ATCAGACCTC TGCGCCCAAC
39151  ACCAGCACTC CTGGGACCTC CACAGTGGAC CTTGGGACCT CAGGGACTCC
39201  ATCCTCCCTC CCCAGCCCTA CATCTGCTGG CCCTCTCCTG GTGCCATTCA
39251  CCCTCAACTT CACCATCACC AACCTGCAGT ACGAGGAGGA CATGCATCAC
39301  CCAGGCTCCA GGAAGTTCAA CACCACGGAG CGGGTCCTGC AGGGTCTGCT
39351  TGGTCCCATG TTCAAGAACA CCAGTGTCGG CCTTCTGTAC TCTGGCTGCA
39401  GACTGACCTT GCTCAGGCCT GAGAAGAATG GGGCAGCCAC TGGAATGGAT
39451  GCCATCTGCA GCCACCGTCT TGACCCCAAA AGCCCTGGAC TCAACAGAGA
39501  GCAGCTGTAC TGGGAGCTGA GCCAGCTGAC CCATGGCATC AAAGAGCTGG
39551  GCCCCTACAC CCTGGACAGG AACAGTCTCT ATGTCAATGG TTTCACCCAT
39601  CGGAGCTCTG TGGCCCCCAC CAGCACTCCT GGGACCTCCA CAGTGGACCT
39651  TGGGACCTCA GGGACTCCAT CCTCCCTCCC CAGCCCCACA ACAGCTGTTC
39701  CTCTCCTGGT GCCGTTCACC CTCAACTTTA CCATCACCAA TCTGCAGTAT
39751  GGGGAGGACA TGCGTCACCC TGGCTCCAGG AAGTTCAACA CCACAGAGAG
39801  GGTCCTGCAG GGTCTGCTTG GTCCCTTGTT CAAGAACTCC AGTGTCGGCC
39851  CTCTGTACTC TGGCTGCAGA CTGATCTCTC TCAGGTCTGA GAAGGATGGG
39901  GCAGCCACTG GAGTGGATGC CATCTGCACC CACCACCTTA ACCCTCAAAG
39951  CCCTGGACTG GACAGGGAGC AGCTGTACTG GCAGCTGAGC CAGATGACCA
40001  ATGGCATCAA AGAGCTGGGC CCCTACACCC TGGACCGGAA CAGTCTCTAC
40051  GTCAATGGTT TCACCCATCG GAGCTCTGGG CTCACCACCA GCACTCCTTG
40101  GACTTCCACA GTTGACCTTG GAACCTCAGG GACTCCATCC CCCGTCCCCA
40151  GCCCCACAAC TGCTGGCCCT CTCCTGGTGC CATTCACCCT CAACTTCACC
40201  ATCACCAACC TGCAGTATGA GGAGGACATG CATCGCCCTG GATCTAGGAA
40251  GTTCAACACC ACAGAGAGGG TCCTGCAGGG TCTGCTTAGT CCCATTTTCA
40301  AGAACTCCAG TGTTGGCCCT CTGTACTCTG GCTGCAGACT GACCTCTCTC
40351  AGGCCCGAGA AGGATGGGGC AGCAACTGGA ATGGATGCTG TCTGCCTCTA
40401  CCACCCTAAT CCCAAAAGAC CTGGACTGGA CAGAGAGCAG CTGTACTGGG
40451  AGCTAAGCCA GCTGACCCAC AACATCACTG AGCTGGGCCC CTACAGCCTG
40501  GACAGGGACA GTCTCTATGT CAATGGTTTC ACCCATCAGA ACTCTGTGCC
40551  CACCACCAGT ACTCCTGGGA CCTCCACAGT GTACTGGGCA ACCACTGGGA
40601  CTCCATCCTC CTTCCCCGGC ACACAGAGC CTGGCCCTCT CCTGATACCA
40651  TTCACTTTCA ACTTTACCAT CACCAACCTG CATTATGAGG AAAACATGCA
```

TABLE 30-continued

Human cDNA of CA125
(SEQ ID NO: 314)

```
40701  ACACCCTGGT TCCAGGAAGT TCAACACCAC GGAGAGGGTT CTGCAGGGTC
40751  TGCTCAAGCC CTTGTTCAAG AACACCAGTG TTGGCCCTCT GTACTCTGGC
40801  TGCAGACTGA CCTCTCTCAG GCCCGAGAAG GATGGGGCAG CAACTGGAAT
40851  GGATGCTGTC TGCCTCTACC ACCCTAATCC CAAAAGACCT GGGCTGGACA
40901  GAGAGCAGCT GTACTGGGAG CTAAGCCAGC TGACCCACAA CATCACTGAG
40951  CTGGGCCCCT ACAGCCTGGA CAGGGACAGT CTCTATGTCA ATGGTTTCAC
41001  CCATCAGAAC TCTGTGCCCA CCACCAGTAC TCCTGGGACC TCCACAGTGT
41051  ACTGGGCAAC CACTGGGACT CCATCCTCCT TCCCCGGCCA CACAGAGCCT
41101  GGCCCTCTCC TGATACCATT CACTTTCAAC TTTACCATCA CCAACCTGCA
41151  TTATGAGGAA AACATGCAAC ACCCTGGTTC CAGGAAGTTC AACACCACGG
41201  AGAGGGTTCT GCAGGGTCTG CTCAAGCCCT TGTTCAAGAA CACCAGTGTT
41251  GGCCCTCTGT ACTCTGGCTG CAGACTGACC TTGCTCAGAC CTGAGAAGCA
41301  TGAGGCAGCC ACTGGAGTGG ACACCATCTG TACCCACCGC GTTGATCCCA
41351  TCGGACCTGG ACTGGACAGG GAGCGGCTAT ACTGGGAGCT GAGCCAGCTG
41401  ACCAACAGCA TTACCGAACT GGGACCCTAC ACCCTGGACA GGGACAGTCT
41451  CTATGTCAAT GGCTTCAACC CTCGGAGCTC TGTGCCAACC ACCAGCACTC
41501  CTGGGACCTC CACAGTGCAC CTGGCAACCT CTGGGACTCC ATCCTCCCTG
41551  CCTGGCCACA CAGCCCCTGT CCCTCTCTTG ATACCATTCA CCCTCAACTT
41601  TACCATCACC AACCTGCATT ATGAGGAAAA CATGCAACAC CCTGGTTCCA
41651  GGAAGTTCAA CACCACGGAG AGGGTTCTGC AGGGTCTGCT CAAGCCCTTG
41701  TTCAAGAACA CCAGTGTTGG CCCTCTGTAC TCTGGCTGCA GACTGACCTT
41751  GCTCAGACCT GAGAAGCATG AGGCAGCCAC TGGAGTGGAC ACCATCTGTA
41801  CCCACCGCGT TGATCCCATC GGACCTGGAC TGNACAGNGA GCNGCTNTAC
41851  TGGGAGCTNA GCCANCTGAC CAANNNCATC NNNGAGCTGG GNCCCTACAC
41901  CCTGGACAGG NACAGTCTCT ATGTCAATGG TTTCACCCAT CNGANCTCTG
41951  NGCCCACCAC CAGCACTCCT GGGACCTCCA CAGTGNACNT NGGNACCTCN
42001  GGGACTCCAT CCTCCNTCCC CNGCCNCACA TCTGCTGGCC CTCTCCTGGT
42051  GCCATTCACC CTCAACTTCA CCATCACCAA CCTGCAGTAC GAGGAGGACA
42101  TGCATCACCC AGGCTCCAGG AAGTTCAACA CCACGGAGCG GGTCCTGCAG
42151  GGTCTGCTTG GTCCCATGTT CAAGAACACC AGTGTCGGCC TTCTGTACTC
42201  TGGCTGCAGA CTGACCTTGC TCAGGCCTGA GAAGAATGGG CAGCCACTG
42251  GAATGGATGC CATCTGCAGC CACCGTCTTG ACCCCAAAAG CCCTGGACTC
42301  GACAGAGAGC AGCTGTACTG GGAGCTGAGC CAGCTGACCC ATGGCATCAA
42351  AGAGCTGGGC CCCTACACCC TGGACAGGAA CAGTCTCTAT GTCAATGGTT
42401  TCACCCATCG GAGCTCTGTG CCCCCACCA GCACTCCTGG GACCTCCACA
42451  GTGGACCTTG GGACCTCAGG GACTCCATCC TCCCTCCCCA GCCCCACAAC
42501  AGCTGTTCCT CTCCTGGTGC CGTTCACCCT CAACTTTACC ATCACCAATC
42551  TGCAGTATGG GGAGGACATG CGTCACCCTG GCTCCAGGAA GTTCAACACC
```

TABLE 30-continued

Human cDNA of CA125
(SEQ ID NO: 314)

```
42601  ACAGAGAGGG TCCTGCAGGG TCTGCTTGGT CCCTTGTTCA AGAACTCCAG

42651  TGTCGGCCCT CTGTACTCTG GCTGCAGACT GATCTCTCTC AGGTCTGAGA

42701  AGGATGGGGC AGCCACTGGA GTGGATGCCA TCTGCACCCA CCACCTTAAC

42751  CCTCAAAGCC CTGGACTGGA CAGGGAGCAG CTGTACTGGC AGCTGAGCCA

42801  GATGACCAAT GGCATCAAAG AGCTGGGCCC CTACACCCTG GACCGGAACA

42851  GTCTCTACGT CAATGGTTTC ACCCATCGGA GCTCTGGGCT CACCACCAGC

42901  ACTCCTTGGA CTTCCACAGT TGACCTTGGA ACCTCAGGGA CTCCATCCCC

42951  CGTCCCCAGC CCCACAACTG CTGGCCCTCT CCTGGTGCCA TTCACCCTAA

43001  ACTTCACCAT CACCAACCTG CAGTATGAGG AGGACATGCA TCGCCCTGGA

43051  TCTAGGAAGT TCAACGCCAC AGAGAGGGTC CTGCAGGGTC TGCTTAGTCC

43101  CATATTCAAG AACTCCAGTG TTGGCCCTCT GTACTCTGGC TGCAGACTGA

43151  CCTCTCTCAG GCCCGAGAAG GATGGGGCAG CAACTGGAAT GGATGCTGTC

43201  TGCCTCTACC ACCCTAATCC CAAAAGACCT GGACTGGACA GAGAGCAGCT

43251  GTACTGGGAG CTAAGCCAGC TGACCCACAA CATCACTGAG CTGGGCCCCT

43301  ACAGCCTGGA CAGGGACAGT CTCTATGTCA ATGGTTTCAC CCATCAGAGC

43351  TCTATGACGA CCACCAGAAC TCCTGATACC TCCACAATGC ACCTGGCAAC

43401  CTCGAGAACT CCAGCCTCCC TGTCTGGACC TACGACCGCC AGCCCTCTCC

43451  TGGTGCTATT CACAATCAAC TGCACCATCA CCAACCTGCA GTACGAGGAG

43501  GACATGCGTC GCACTGGCTC CAGGAAGTTC AACACCATGG AGAGTGTCCT

43551  GCAGGGTCTG CTCAAGCCCT TGTTCAAGAA CACCAGTGTT GGCCCTCTGT

43601  ACTCTGGCTG CAGATTGACC TTGCTCAGGC CAAGAAAGA TGGGGCAGCC

43651  ACTGGAGTGG ATGCCATCTG CACCCACCGC CTTGACCCCA AAAGCCCTGG

43701  ACTCAACAGG GAGCAGCTGT ACTGGGAGCT AAGCAAACTG ACCAATGACA

43751  TTGAAGAGCT GGGCCCCTAC ACCCTGGACA GGAACAGTCT CTATGTCAAT

43801  GGTTTCACCC ATCAGAGCTC TGTGTCCACC ACCAGCACTC CTGGGACCTC

43851  CACAGTGGAT CTCAGAACCT CAGGGACTCC ATCCTCCCTC TCCAGCCCCA

43901  CAATTATGNC NNCTGNCCCT CTCCTGNTNC CNTTCACCNT CAACTTNACC

43951  ATCACCAACC TGCANTANGN GGANNACATG CNNCNCCCNG GNTCCAGGAA

44001  GTTCAACACC ACNGAGAGGG TCCTACAGGG TCTGCTCAGG CCCTTGTTCA

44051  AGAACACCAG TGTCAGCTCT CTGTACTCTG GTTGCAGACT GACCTTGCTC

44101  AGGCCTGAGA AGGATGGGGC AGCCACCAGA GTGGATGCTG CCTGCACCTA

44151  CCGCCCTGAT CCCAAAAGCC CTGGACTGGA CAGAGAGCAA CTATACTGGG

44201  AGCTGAGCCA GCTAACCCAC AGCATCACTG AGCTGGGACC CTACACCCTG

44251  GACAGGGTCA GTCTCTATGT CAATGGCTTC AACCCTCGGA GCTCTGTGCC

44301  AACCACCAGC ACTCCTGGGA CCTCCACAGT GCACCTGGCA ACCTCTGGGA

44351  CTCCATCCTC CCTGCCTGGC CACACANCNN CTGNCCCTCT CCTGNTNCCN

44401  TTCACCNTCA ACTTNACCAT CACCAACCTG CANTANGNGG ANNACATGCN

44451  NCNCCCNGGN TCCAGGAAGT TCAACACCAC NGAGAGGGTT CTGCAGGGTC

44501  TGCTCAAACC CTTGTTCAGG AATAGCAGTC TGGAATACCT CTATTCAGGC
```

TABLE 30-continued

Human cDNA of CA125
(SEQ ID NO: 314)

```
44551  TGCAGACTAG CCTCACTCAG GCCAGAGAAG GATAGCTCAG CCATGGCAGT
44601  GGATGCCATC TGCACACATC GCCCTGACCC TGAAGACCTC GGACTGGACA
44651  GAGAGCGACT GTACTGGGAG CTGAGCAATC TGACAAATGG CATCCAGGAG
44701  CTGGGCCCCT ACACCCTGGA CCGGAACAGT CTCTACGTCA ATGGTTTCAC
44751  CCATCGGAGC TCTGGGCTCA CCACCAGCAC TCCTTGGACT TCCACAGTTG
44801  ACCTTGGAAC CTCAGGGACT CCATCCCCCG TCCCCAGCCC CACAACTGCT
44851  GGCCCTCTCC TGGTGCCATT CACCCTCAAC TTCACCATCA CCAACCTGCA
44901  GTATGAGGAG GACATGCATC GCCCTGGTTC CAGGAGGTTC AACACCACGG
44951  AGAGGGTTCT GCAGGGTCTG CTCACGCCCT TGTTCAAGAA CACCAGTGTT
45001  GGCCCTCTGT ACTCTGGCTG CAGACTGACC TTGCTCAGAC TGAGAAGCA
45051  AGAGGCAGCC ACTGGAGTGG ACACCATCTG TACCCACCGC GTTGATCCCA
45101  TCGGACCTGG ACTGGACAGA GAGCGGCTAT ACTGGGAGCT GAGCCAGCTG
45151  ACCAACAGCA TCACAGAGCT GGGACCCTAC ACCCTGGATA GGGACAGTCT
45201  CTATGTCAAT GGCTTCAACC CTTGGAGCTC TGTGCCAACC ACCAGCACTC
45251  CTGGGACCTC CACAGTGCAC CTGGCAACCT CTGGGACTCC ATCCTCCCTG
45301  CCTGGCCACA CAGCCCCTGT CCCTCTCTTG ATACCATTCA CCCTCAACTT
45351  TACCATCACC GACCTGCATT ATGAAGAAAA CATGCAACAC CCTGGTTCCA
45401  GGAAGTTCAA CACCACGGAG AGGGTTCTGC AGGGTCTGCT CAAGCCCTTG
45451  TTCAAGAGCA CCAGCGTTGG CCCTCTGTAC TCTGGCTGCA GACTGACCTT
45501  GCTCAGACCT GAGAAACATG GGGCAGCCAC TGGAGTGGAC GCCATCTGCA
45551  CCCTCCGCCT TGATCCCACT GGTCCTGGAC TGGACAGAGA GCGGCTATAC
45601  TGGGAGCTGA GCCAGCTGAC CAACAGCGTT ACAGAGCTGG CCCCTACAC
45651  CCTGGACAGG GACAGTCTCT ATGTCAATGG CTTCACCCAT CGGAGCTCTG
45701  TGCCAACCAC CAGTATTCCT GGGACCTCTG CAGTGCACCT GGAAACCTCT
45751  GGGACTCCAG CCTCCCTCCC TGGCCACACA GCCCCTGGCC CTCTCCTGGT
45801  GCCATTCACC CTCAACTTCA CTATCACCAA CCTGCAGTAT GAGGAGGACA
45851  TGCGTCACCC TGGTTCCAGG AAGTTCAGCA CCACGGAGAG AGTCCTGCAG
45901  GGTCTGCTCA AGCCCTTGTT CAAGAACACC AGTGTCAGCT CTCTGTACTC
45951  TGGTTGCAGA CTGACCTTGC TCAGGCCTGA GAAGGATGGG CAGCCACCA
46001  GAGTGGATGC TGTCTGCACC CATCGTCCTG ACCCCAAAAG CCCTGGACTG
46051  GACAGAGAGC GGCTGTACTG GAAGCTGAGC CAGCTGACCC ACGGCATCAC
46101  TGAGCTGGGC CCCTACACCC TGGACAGGCA CAGTCTCTAT GTCAATGGTT
46151  TCACCCATCA GAGCTCTATG ACGACCACCA GAACTCCTGA TACCTCCACA
46201  ATGCACCTGG CAACCTCGAG AACTCCAGCC TCCCTGTCTG GACCTACGAC
46251  CGCCAGCCCT CTCCTGGTGC TATTCACAAT TAACTTCACC ATCACTAACC
46301  TGCGGTATGA GGAGAACATG CATCACCCTG GCTCTAGAAA GTTTAACACC
46351  ACGGAGAGAG TCCTTCAGGG TCTGCTCAGG CCTGTGTTCA AGAACACCAG
46401  TGTTGGCCCT CTGTACTCTG GCTGCAGACT GACCACGCTC AGGCCCAAGA
```

TABLE 30-continued

Human cDNA of CA125
(SEQ ID NO: 314)

| | | | | | |
|---|---|---|---|---|---|
| 46451 | AGGATGGGGC | AGCCACCAAA | GTGGATGCCA | TCTGCACCTA | CCGCCCTGAT |
| 46501 | CCCAAAAGCC | CTGGACTGGA | CAGAGAGCAG | CTATACTGGG | AGCTGAGCCA |
| 46551 | GCTAACCCAC | AGCATCACTG | AGCTGGGCCC | CTACACCCAG | GACAGGGACA |
| 46601 | GTCTCTATGT | CAATGGCTTC | ACCCATCGGA | GCTCTGTGCC | AACCACCAGT |
| 46651 | ATTCCTGGGA | CCTCTGCAGT | GCACCTGGAA | ACCTCTGGGA | CTCCAGCCTC |
| 46701 | CCTCCCTGGC | CACACAGCCC | CTGGCCCTCT | CCTGGTGCCA | TTCACCCTCA |
| 46751 | ACTTCACTAT | CACCAACCTG | CAGTATGAGG | AGGACATGCG | TCACCCTGGT |
| 46801 | TCCAGGAAGT | CAACACCAC | GGAGAGAGTC | CTGCAGGGTC | TGCTCAAGCC |
| 46851 | CTTGTTCAAG | AGCACCAGTG | TTGGCCCTCT | GTACTCTGGC | TGCAGACTGA |
| 46901 | CCTTGCTCAG | GCCTGAAAAA | CGTGGGGCAG | CCACCGGCGT | GGACACCATC |
| 46951 | TGCACTCACC | GCCTTGACCC | TCTAAACCCA | GGACTGGACA | GAGAGCAGCT |
| 47001 | ATACTGGGAG | CTGAGCAAAC | TGACCCGTGG | CATCATCGAG | CTGGGCCCCT |
| 47051 | ACCTCCTGGA | CAGAGGCAGT | CTCTATGTCA | ATGGTTTCAC | CCATCGGACC |
| 47101 | TCTGTGCCCA | CCACCAGCAC | TCCTGGGACC | TCCACAGTGG | ACCTTGGAAC |
| 47151 | CTCAGGGACT | CCATTCTCCC | TCCCAAGCCC | CGCANCNNCT | GNCCCTCTCC |
| 47201 | TGNTNCCNTT | CACCNTCAAC | TTNACCATCA | CCAACCTGCA | NTANGNGGAN |
| 47251 | NACATGCNNC | NCCCNGGNTC | CAGGAAGTTC | AACACCACNG | AGAGGGTCCT |
| 47301 | GCAGACTCTG | CTTGGTCCTA | TGTTCAAGAA | CACCAGTGTT | GGCCTTCTGT |
| 47351 | ACTCTGGCTG | CAGACTGACC | TTGCTCAGGT | CCGAGAAGGA | TGGAGCAGCC |
| 47401 | ACTGGAGTGG | ATGCCATCTG | CACCCACCGT | CTTGACCCCA | AAAGCCCTGG |
| 47451 | AGTGGACAGG | GAGCAACTAT | ACTGGGAGCT | GAGCCAGCTG | ACCAATGGCA |
| 47501 | TTAAAGAACT | GGGCCCCTAC | ACCCTGGACA | GGAACAGTCT | CTATGTCAAT |
| 47551 | GGGTTCACCC | ATTGGATCCC | TGTGCCCACC | AGCAGCACTC | CTGGGACCTC |
| 47601 | CACAGTGGAC | CTTGGGTCAG | GGACTCCATC | CTCCCTCCCC | AGCCCCACAA |
| 47651 | CTGCTGGCCC | TCTCCTGGTG | CCGTTCACCC | TCAACTTCAC | CATCACCAAC |
| 47701 | CTGAAGTACG | AGGAGGACAT | GCATTGCCCT | GGCTCCAGGA | AGTTCAACAC |
| 47751 | CACAGAGAGA | GTCCTGCAGA | GTCTGCTTGG | TCCCATGTTC | AAGAACACCA |
| 47801 | GTGTTGGCCC | TCTGTACTCT | GGCTGCAGAC | TGACCTTGCT | CAGGTCCGAG |
| 47851 | AAGGATGGAG | CAGCCACTGG | AGTGGATGCC | ATCTGCACCC | ACCGTCTTGA |
| 47901 | CCCCAAAAGC | CCTGGAGTGG | ACAGGGAGCA | GCTATACTGG | GAGCTGAGCC |
| 47951 | AGCTGACCAA | TGGCATCAAA | GAGCTGGGTC | CCTACACCCT | GGACAGAAAC |
| 48001 | AGTCTCTATG | TCAATGGTTT | CACCCATCAG | ACCTCTGCGC | CAACACCAG |
| 48051 | CACTCCTGGG | ACCTCCACAG | TGGACCTTGG | GACCTCAGGG | ACTCCATCCT |
| 48101 | CCCTCCCCAG | CCCTACANCN | NCTGNCCCTC | TCCTGNTNCC | NTTCACCNTC |
| 48151 | AACTTNACCA | TCACCAACCT | GCANTANGNG | GANNACATGC | NNCNCCCNGG |
| 48201 | NTCCAGGAAG | TTCAACACCA | CNGAGNGNGT | NCTGCAGGGT | CTGCTNNNNC |
| 48251 | CCNTNTTCAA | GAACNCCAGT | GTNGGCCNTC | TGTACTCTGG | CTGCAGACTG |
| 48301 | ACCTNNCTCA | GGNCNGAGAA | GNATGGNGCA | GCCACTGGAN | TGGATGCCAT |
| 48351 | CTGCANCCAC | CNNCNTNANC | CCAAAAGNCC | TGGACTGNAC | AGNGAGCNGC |

TABLE 30-continued

Human cDNA of CA125
(SEQ ID NO: 314)

```
48401  TNTACTGGGA GCTNAGCCAN CTGACCAANN NCATCNNNGA GCTGGGNCCC

48451  TACACCCTGG ACAGGNACAG TCTCTATGTC AATGGTTTCA CCCATTGGAT

48501  CCCTGTGCCC ACCAGCAGCA CTCCTGGGAC CTCCACAGTG GACCTTGGGT

48551  CAGGGACTCC ATCCTCCCTC CCCAGCCCCA CAACTGCTGG CCCTCTCCTG

48601  GTGCCGTTCA CCCTCAACTT CACCATCACC AACCTGAAGT ACGAGGAGGA

48651  CATGCATTGC CCTGGCTCCA GGAAGTTCAA CACCCAGAG AGAGTCCTGC

48701  AGAGTCTGCT TGGTCCCATG TTCAAGAACA CCAGTGTTGG CCCTCTGTAC

48751  TCTGGCTGCA GACTGACCTC GCTCAGGTCC GAGAAGGATG GAGCAGCCAC

48801  TGGAGTGGAT GCCATCTGCA CCCACCGTGT TGACCCCAAA GCCCTGGAG

48851  TGGACAGGGA GCAGCTATAC TGGGAGCTGA GCCAGCTGAC CAATGGCATC

48901  AAAGAGCTGG GTCCCTACAC CCTCGACAGA AACAGTCTCT ATGTCAATGG

48951  TTTCACCCAT CAGACCTCTG CGCCCAACAC CAGCACTCCT GGGACCTCCA

49001  CAGTGNACNT NGGNACCTCN GGGACTCCAT CCTCCNTCCC CNGCCNCACA

49051  TCTGCTGGCC CTCTCCTGGT GCCATTCACC CTCAACTTCA CCATCACCAA

49101  CCTGCAGTAC GAGGAGGACA TGCATCACCC AGGCTCCAGG AAGTTCAACA

49151  CCACGGAGCG GGTCCTGCAG GGTCTGCTTG GTCCCATGTT CAAGAACACC

49201  AGTGTCGGCC TTCTGTACTC TGGCTGCAGA CTGACCTTGC TCAGGCCTGA

49251  GAAGAATGGG GCAACCACTG GAATGGATGC CATCTGCACC CACCGTCTTG

49301  ACCCCAAAAG CCCTGGACTG NACAGNGAGC NGCTNTACTG GGAGCTNAGC

49351  CANCTGACCA ANNNCATCNN NGAGCTGGGN CCCTACACCC TGGACAGGNA

49401  CAGTCTCTAT GTCAATGGTT TCACCCATCN GANCTCTGNG CCCACCACCA

49451  GCACTCCTGG GACCTCCACA GTGNACNTNG GNACCTCNGG GACTCCATCC

49501  TCCNTCCCCN GCCNCACANC NNCTGNCCCT CTCCTGNTNC CNTTCACCNT

49551  CAACTTNACC ATCACCAACC TGCANTANGN GGANNACATG CNNCNCCCNG

49601  GNTCCAGGAA GTTCAACACC ACNGAGAGGG TTCTGCAGGG TCTGCTCAAA

49651  CCCTTGTTCA GGAATAGCAG TCTGGAATAC CTCTATTCAG GCTGCAGACT

49701  AGCCTCACTC AGGCCAGAGA AGGATAGCTC AGCCATGGCA GTGGATGCCA

49751  TCTGCACACA TCGCCCTGAC CCTGAAGACC TCGGACTGGA CAGAGAGCGA

49801  CTGTACTGGG AGCTGAGCAA TCTGACAAAT GGCATCCAGG AGCTGGGCCC

49851  CTACACCCTG GACCGGAACA GTCTCTATGT CAATGGTTTC ACCCATCGAA

49901  GCTCTATGCC CACCACCAGC ACTCCTGGGA CCTCCACAGT GGATGTGGGA

49951  ACCTCAGGGA CTCCATCCTC CAGCCCCAGC CCACGACTG CTGGCCCTCT

50001  CCTGATACCA TTCACCCTCA ACTTCACCAT CACCAACCTG CAGTATGGGG

50051  AGGACATGGG TCACCCTGGC TCCAGGAAGT TCAACACCAC AGAGAGGGTC

50101  CTGCAGGGTC TGCTTGGTCC CATATTCAAG AACACCAGTG TTGGCCCTCT

50151  GTACTCTGGC TGCAGACTGA CCTCTCTCAG GTCTGAGAAG GATGGAGCAG

50201  CCACTGGAGT GGATGCCATC TGCATCCATC ATCTTGACCC CAAAAGCCCT

50251  GGACTCAACA GAGAGCGGCT GTACTGGGAG CTGAGCCAAC TGACCAATGG
```

TABLE 30-continued

Human cDNA of CA125
(SEQ ID NO: 314)

```
50301  CATCAAAGAG CTGGGCCCCT ACACCCTGGA CAGGAACAGT CTCTATGTCA
50351  ATGGTTTCAC CCATCGGACC TCTGTGCCCA CCACCAGCAC TCCTGGGACC
50401  TCCACAGTGG ACCTTGGAAC CTCAGGGACT CCATTCTCCC TCCCAAGCCC
50451  CGCAACTGCT GGCCCTCTCC TGGTGCTGTT CACCCTCAAC TTCACCATCA
50501  CCAACCTGAA GTATGAGGAG GACATGCATC GCCCTGGCTC CAGGAAGTTC
50551  AACACCACTG AGAGGGTCCT GCAGACTCTG CTTGGTCCTA TGTTCAAGAA
50601  CACCAGTGTT GGCCTTCTGT ACTCTGGCTG CAGACTGACC TTGCTCAGGT
50651  CCGAGAAGGA TGGAGCAGCC ACTGGAGTGG ATGCCATCTG CACCCACCGT
50701  CTTGACCCCA AAAGCCCTGG ACTGNACAGN GAGCNGCTNT ACTGGGAGCT
50751  NAGCCANCTG ACCAANNNCA TCNNNGAGCT GGGNCCCTAC ACCCTGGACA
50801  GGNACAGTCT CTATGTCAAT GGTTTCACCC ATCNGANCTC TGNGCCCACC
50851  ACCAGCACTC CTGGGACCTC CACAGTGNAC NTNGGNACCT CNGGGACTCC
50901  ATCCTCCNTC CCCNGCCNCA CANCNNCTGN CCCTCTCCTG NTNCCNTTCA
50951  CCNTCAACTT NACCATCACC AACCTGCANT ANGNGGANNA CATGCNNCNC
51001  CCNGGNTCCA GGAAGTTCAA CACCACNGAG AGAGTCCTTC AGGGTCTGCT
51051  CAGGCCTGTG TTCAAGAACA CCAGTGTTGG CCCTCTGTAC TCTGGCTGCA
51101  GACTGACCTT GCTCAGGCCC AAGAAGGATG GGCAGCCAC CAAAGTGGAT
51151  GCCATCTGCA CCTACCGCCC TGATCCCAAA AGCCCTGGAC TGGACAGAGA
51201  GCAGCTATAC TGGCAGCTGA GCCAGCTAAC CCACAGCATC ACTGAGCTGG
51251  GCCCCTACAC CCAGGACAGG GACAGTCTCT ATGTCAATGG CTTCACCCAT
51301  CGGAGCTCTG TGCCAACCAC CAGTATTCCT GGGACCTCTG CAGTGCACCT
51351  GGAAACCACT GGGACTCCAT CCTCCTTCCC CGGCCACACA GAGCCTGGCC
51401  CTCTCCTGAT ACCATTCACT TTCAACTTTA CCATCACCAA CCTGCGTTAT
51451  GAGGAAAACA TGCAACACCC TGGTTCCAGG AAGTTCAACA CCACGGAGAG
51501  GGTTCTGCAG GGTCTGCTCA CGCCCTTGTT CAAGAACACC AGTGTTGGCC
51551  CTCTGTACTC TGGCTGCAGA CTGACCTTGC TCAGACCTGA GAAGCAGGAG
51601  GCAGCCACTG GAGTGGACAC CATCTGTACC CACCGCGTTG ATCCCATCGG
51651  ACCTGGACTG GACAGAGAGC GGCTATACTG GGAGCTGAGC CAGCTGACCA
51701  ACAGCATCAC AGAGCTGGGA CCCTACACCC TGGATAGGGA CAGTCTCTAT
51751  GTCGATGGCT TCAACCCTTG GAGCTCTGTG CCAACCACCA GCACTCCTGG
51801  GACCTCCACA GTGCACCTGG CAACCTCTGG GACTCCATCC CCCTGCCTG
51851  GCCACACAGC CCCTGTCCCT CTCTTGATAC CATTCACCCT CAACTTTACC
51901  ATCACCGACC TGCATTATGA AGAAAACATG CAACACCCTG GTTCCAGGAA
51951  GTTCAACACC ACGGAGAGGG TTCTGCAGGG TCTGCTCAAG CCCTTGTTCA
52001  AGAGCACCAG CGTTGGCCCT CTGTACTCTG GCTGCAGACT GACCTTGCTC
52051  AGACCTGAGA ACATGGGGC AGCCACTGGA GTGGACGCCA TCTGCACCCT
52101  CCGCCTTGAT CCCACTGGTC CTGGACTGGA CAGAGAGCGG CTATACTGGG
52151  AGCTGAGCCA GCTGACCAAC AGCATCACAG AGCTGGGACC CTACACCCTG
52201  GATAGGGACA GTCTCTATGT CAATGGCTTC AACCCTTGGA GCTCTGTGCC
```

TABLE 30-continued

Human cDNA of CA125
(SEQ ID NO: 314)

```
52251  AACCACCAGC ACTCCTGGGA CCTCCACAGT GCACCTGGCA ACCTCTGGGA
52301  CTCCATCCTC CCTGCCTGGC CACACAACTG CTGGCCCTCT CCTGGTGCCG
52351  TTCACCCTCA ACTTCACCAT CACCAACCTG AAGTACGAGG AGGACATGCA
52401  TTGCCCTGGC TCCAGGAAGT TCAACACCAG AGAGAGAGTC CTGCAGAGTC
52451  TGCATGGTCC CATGTTCAAG AACACCAGTG TTGGCCCTCT GTACTCTGGC
52501  TGCAGACTGA CCTTGCTCAG GTCCGAGAAG GATGGAGCAG CCACTGGAGT
52551  GGATGCCATC TGCACCCACC GTCTTGACCC CAAAAGCCCT GGACTGNACA
52601  GNGAGCNGCT NTACTGGGAG CTNAGCCANC TGACCAANNN CATCNNNGAG
52651  CTGGGNCCCT ACACCCTGGA CAGGNACAGT CTCTATGTCA ATGGTTTCAC
52701  CCATCNGANC TCTGNGCCCA CCACCAGCAC TCCTGGGACC TCCACAGTGN
52751  ACNTNGGNAC CTCNGGGACT CCATCCTCCN TCCCCNGCCN CACANCNNCT
52801  GNCCCTCTCC TGNTNCCNTT CACCNTCAAC TTNACCATCA CCAACCTGCA
52851  NTANGNGGAN NACATGCNNC NCCCNGGNTC CAGGAAGTTC AACACCACNG
52901  AGNGNGTNCT GCAGGGTCTG CTNNNNCCCN TNTTCAAGAA CNCCAGTGTN
52951  GGCCNTCTGT ACTCTGGCTG CAGACTGACC TNNCTCAGGN CNGAGAAGNA
53001  TGGNGCAGCC ACTGGANTGG ATGCCATCTG CANCCACCNN CNTNANCCCA
53051  AAAGNCCTGG ACTGNACAGN GAGCNGCTNT ACTGGGAGCT NAGCCANCTG
53101  ACCAACAGCA TCACAGAGCT GGGACCCTAC ACCCTGGATA GGGACAGTCT
53151  CTATGTCAAT GGTTTCACCC ATCGAAGCTC TATGCCCACC ACCAGTATTC
53201  CTGGGACCTC TGCAGTGCAC CTGGAAACCT CTGGGACTCC AGCCTCCCTC
53251  CCTGGCCACA CAGCCCCTGG CCCTCTCCTG GTGCCATTCA CCCTCAACTT
53301  CACTATCACC AACCTGCAGT ATGAGGAGGA CATGCGTCAC CCTGGTTCCA
53351  GGAAGTTCAA CACCACGGAG AGAGTCCTGC AGGGTCTGCT CAAGCCCTTG
53401  TTCAAGAGCA CCAGTGTTGG CCCTCTGTAC TCTGGCTGCA GACTGACCTT
53451  GCTCAGGCCT GAAAAACGTG GGGCAGCCAC CGGCGTGGAC ACCATCTGCA
53501  CTCACCGCCT TGACCCTCTA AACCCTGGAC TGNACAGNGA GCNGCTNTAC
53551  TGGGAGCTNA GCCANCTGAC CAANNNCATC NNNGAGCTGG GNCCCTACAC
53601  CCTGGACAGG NACAGTCTCT ATGTCAATGG TTTCACCCAT CNGANCTCTG
53651  NGCCCACCAC CAGCACTCCT GGGACCTCCA CAGTGNACNT NGGNACCTCN
53701  GGGACTCCAT CCTCCNTCCC CNGCCNCACA NCNNCTGNCC CTCTCCTGNT
53751  NCCNTTCACC NTCAACTTNA CCATCACCAA CCTGCANTAN GNGGANNACA
53801  TGCNNCNCCC NGGNTCCAGG AAGTTCAACA CCACNGAGNG NGTNCTGCAG
53851  GGTCTGCTNN NNCCCNTNTT CAAGAACNCC AGTGTNGGCC NTCTGTACTC
53901  TGGCTGCAGA CTGACCTNNC TCAGGNCNGA GAAGNATGGN GCAGCCACTG
53951  GANTGGATGC CATCTGCANC CACCNNCNTN ANCCCAAAAG NCCTGGACTG
54001  NACAGNGAGC NGCTNTACTG GGAGCTNAGC CANCTGACCA ANNNCATCNN
54051  NGAGCTGGGN CCCTACACCC TGGACAGGNA CAGTCTCTAT GTCAATGGTT
54101  TTCACCCTCG GAGCTCTGTG CCAACCACCA GCACTCCTGG GACCTCCACA
```

TABLE 30-continued

Human cDNA of CA125
(SEQ ID NO: 314)

```
54151  GTGCACCTGG CAACCTCTGG GACTCCATCC TCCCTGCCTG GCCACACAGC
54201  CCCTGTCCCT CTCTTGATAC CATTCACCCT CAACTTTACC ATCACCAACC
54251  TGCATTATGA AGAAAACATG CAACACCCTG GTTCCAGGAA GTTCAACACC
54301  ACGGAGCGGG TCCTGCAGGG TCTGCTTGGT CCCATGTTCA AGAAAACATG
54351  TGTCGGCCTT CTGTACTCTG GCTGCAGACT GACCTTGCTC AGGCCTGAGA
54401  AGAATGGGGC AGCCACTGGA ATGGATGCCA TCTGCAGCCA CCGTCTTGAC
54451  CCCAAAAGCC CTGGACTGNA CAGNGAGCNG CTNTACTGGG AGCTNAGCCA
54501  NCTGACCAAN NNCATCNNNG AGCTGGGNCC CTACACCCTG GACAGGNACA
54551  GTCTCTATGT CAATGGTTTC ACCCATCNGA NCTCTGNGCC CACCACCAGC
54601  ACTCCTGGGA CCTCCACAGT GNACNTNGGN ACCTCNGGGA CTCCATCCTC
54651  CNTCCCCNGC CNCACANCNN CTGNCCCTCT CCTGNTNCCN TTCACCNTCA
54701  ACTTNACCAT CACCAACCTG CANTANGNGG ANNACATGCN NCNCCCNGGN
54751  TCCAGGAAGT TCAACACCAC NGAGNGNGTN CTGCAGGGTC TGCTNNNNCC
54801  CNTNTTCAAG AACNCCAGTG TNGGCCNTCT GTACTCTGGC TGCAGACTGA
54851  CCTNNCTCAG GNCNGAGAAG NATGGNGCAG CCACTGGANT GGATGCCATC
54901  TGCANCCACC NNCNTNANCC CAAAAGNCCT GGACTGNACA GNGAGCNGCT
54951  NTACTGGGAG CTNAGCCANC TGACCAANNN CATCNNNGAG CTGGGNCCCT
55001  ACACCCTGGA CAGGNACAGT CTCTATGTCA ATGGTTTCAC CCATCAGAAC
55051  TCTGTGCCCA CCACCAGTAC TCCTGGGACC TCCACAGTGT ACTGGGCAAC
55101  CACTGGGACT CCATCCTCCT TCCCCGGCCA CACAGAGCCT GGCCCTCTCC
55151  TGATACCATT CACTTTCAAC TTTACCATCA CCAACCTGCA TTATGAGGAA
55201  AACATGCAAC ACCCTGGTTC CAGGAAGTTC AACACCACGG AGAGGGTTCT
55251  GCAGGGTCTG CTCACGCCCT TGTTCAAGAA CACCAGTGTT GGCCCTCTGT
55301  ACTCTGGCTG CAGACTGACC TTGCTCAGAC CTGAGAAGCA GGAGGCAGCC
55351  ACTGGAGTGG ACACCATCTG TACCCACCGC GTTGATCCCA TCGGACCTGG
55401  ACTGNACAGN GAGCNGCTNT ACTGGGAGCT NAGCCANCTG ACCAANNNCA
55451  TCNNNGAGCT GGGNCCCTAC ACCCTGGACA GGNACAGTCT CTATGTCAAT
55501  GGTTTCACCC ATCNGANCTC TGNGCCCACC ACCAGCACTC CTGGGACCTC
55551  CACAGTGNAC NTGGNACCT CNGGGACTCC ATCCTCCNTC CCCNGCCNCA
55601  CANCNNCTGN CCCTCTCCTG NTNCCNTTCA CCNTCAACTT NACCATCACC
55651  AACCTGCANT ANGNGGANNA CATGCNNCNC CCNGGNTCCA GGAAGTTCAA
55701  CACCACNGAG NGNGTNCTGC AGGGTCTGCT NNNNCCCNTN TTCAAGAACN
55751  CCAGTGTNGG CCNTCTGTAC TCTGGCTGCA GACTGACCTN NCTCAGGNCN
55801  GAGAAGNATG GNGCAGCCAC TGGANTGGAT GCCATCTGCA NCCACCNNCN
55851  TNACCCCAAA AGNCCTGGAC TGNACAGNGA GCNGCTNTAC TGGGAGCTNA
55901  GCCANCTGAC CAANNNCATC NNNGAGCTGG GNCCCTACAC CCTGGACAGG
55951  NACAGTCTCT ATGTCAATGG TTTCACCCAT CGGAGCTCTG TGCCAACCAC
56001  CAGCAGTCCT GGGACCTCCA CAGTGCACCT GGCAACCTCT GGGACTCCAT
56051  CCTCCCTGCC TGGCCACACA GCCCCTGTCC CTCTCTTGAT ACCATTCACC
```

TABLE 30-continued

Human cDNA of CA125
(SEQ ID NO: 314)

```
56101  CTCAACTTTA CCATCACCAA CCTGCATTAT GAAGAAAACA TGCAACACCC
56151  TGGTTCCAGG AAGTTCAACA CCACGGAGAG GGTTCTGCAG GGTCTGCTCA
56201  AGCCCTTGTT CAAGAGCACC AGTGTTGGCC CTCTGTACTC TGGCTGCAGA
56251  CTGACCTTGC TCAGACCTGA GAAACATGGG GCAGCCACTG GAGTGGACGC
56301  CATCTGCACC CTCCGCCTTG ATCCCACTGG TCCTGGACTG NACAGNGAGC
56351  NGCTNTACTG GGAGCTNAGC CANCTGACCA ANNNCATCNN NGAGCTGGGN
56401  CCCTACACCC TGGACAGGNA CAGTCTCTAT GTCAATGGTT TCACCCATCN
56451  GANCTCTGNG CCCACCACCA GCACTCCTGG GACCTCCACA GTGNACNTNG
56501  GNACCTCNGG GACTCCATCC TCCNTCCCCN GCCNCACANC NNCTGNCCCT
56551  CTCCTGNTNC CNTTCACCNT CAACTTNACC ATCACCAACC TGCANTANGN
56601  GGANNACATG CNNCNCCCNG GNTCCAGGAA GTTCAACACC ACNGAGNGNG
56651  TNCTGCAGGG TCTGCTNNNN CCCNTNTTCA AGAACNCCAG TGTNGGCCNT
56701  CTGTACTCTG GCTGCAGACT GACCTNNCTC AGGNCNGAGA AGNATGGNGC
56751  AGCCACTGGA NTGGATGCCA TCTGCANCCA CCNNCNTNAN CCCAAAAGNC
56801  CTGGACTGNA CAGNGAGCNG CTNTACTGGG AGCTNAGCCA NCTGACCAAN
56851  NNCATCNNNG AGCTGGGNCC CTACACCCTG GACAGGNACA GTCTCTATGT
56901  CAATGGTTTC ACCCATCGGA CCTCTGTGCC CACCACCAGC ACTCCTGGGA
56951  CCTCCACAGT GCACCTGGCA ACCTCTGGGA CTCCATCCTC CCTGCCTGGC
57001  CACACAGCCC CTGTCCCTCT CTTGATACCA TTCACCCTCA ACTTTACCAT
57051  CACCAACCTG CAGTATGAGG AGGACATGCA TCGCCCTGGA TCTAGGAAGT
57101  TCAACACCAC AGAGAGGGTC CTGCAGGGTC TGCTTAGTCC CATTTTCAAG
57151  AACTCCAGTG TTGGCCCTCT GTACTCTGGC TGCAGACTGA CCTCTCTCAG
57201  GCCCGAGAAG GATGGGGCAG CAACTGGAAT GGATGCTGTC TGCCTCTACC
57251  ACCCTAATCC CAAAAGACCT GGGCTGGACA GAGAGCAGCT GTACTGCGAG
57301  CTAAGCCAGC TGACCCACAA CATCACTGAG CTGGGCCCCT ACAGCCTGGA
57351  CAGGGACAGT CTCTATGTCA ATGGTTTCAC CCATCAGAAC TCTGTGCCCA
57401  CCACCAGTAC TCCTGGGACC TCCACAGTGT ACTGGGCAAC CACTGGGACT
57451  CCATCCTCCT TCCCCGGCCA CACANCNNCT GNCCCTCTCC TGNTNCCNTT
57501  CACCNTCAAC TTNACCATCA CCAACCTGCA NTANGNGGAN NACATGCNNC
57551  NCCCNGGNTC CAGGAAGTTC AACACCACNG AGNGNGTNCT GCAGGGTCTG
57601  CTNNNNCCCN TNTTCAAGAA CNCCAGTGTN GGCCNTCTGT ACTCTGGCTG
57651  CAGACTGACC TNNCTCAGGN CNGAGAAGNA TGGNGCAGCC ACTGGANTGG
57701  ATGCCATCTG CANCCACCNN CNTNANCCCA AAAGNCCTGG ACTGNACAGN
57751  GAGCNGCTNT ACTGGGAGCT NAGCCANCTG ACCAANNNCA TCNNNGAGCT
57801  GGGNCCCTAC ACCCTGGACA GGNACAGTCT CTATGTCAAT GGTTTCACCC
57851  ATTGGAGCTC TGGGCTCACC ACCAGCACTC CTTGGACTTC CACAGTTGAC
57901  CTTGGAACCT CAGGGACTCC ATCCCCGTC CCCAGCCCCA CAACTGCTGG
57951  CCCTCTCCTG GTGCCATTCA CCCTAAACTT CACCATCACC AACCTGCAGT
```

TABLE 30-continued

Human cDNA of CA125
(SEQ ID NO: 314)

```
58001  ATGAGGAGGA CATGCATCGC CCTGGATCTA GGAAGTTCAA CGCCACAGAG
58051  AGGGTCCTGC AGGGTCTGCT TAGTCCCATA TTCAAGAACA CCAGTGTTGG
58101  CCCTCTGTAC TCTGGCTGCA GACTGACCTT GCTCAGACCT GAGAAGCAGG
58151  AGGCAGCCAC TGGAGTGGAC ACCATCTGTA CCCACCGCGT TGATCCCATC
58201  GGACCTGGAC TGNACAGNGA GCNGCTNTAC TGGGAGCTNA GCCANCTGAC
58251  CAANNNCATC NNNGAGCTGG GNCCCTACAC CCTGGACAGG NACAGTCTCT
58301  ATGTCAATGG TTTCACCCAT CNGANCTCTG NGCCCACCAC CAGCACTCCT
58351  GGGACCTCCA CAGTGNACNT NGGNACCTCN GGGACTCCAT CCTCCNTCCC
58401  CNGCCNCACA NCNNCTGNCC CTCTCCTGNT NCCNTTCACC NTCAACTTNA
58451  CCATCACCAA CCTGCANTAN GNGGANNACA TGCNNCNCCC NGGNTCCAGG
58501  AAGTTCAACA CCACNGAGNG NGTNCTGCAG GGTCTGCTNN NNCCCNTNTT
58551  CAAGAACNCC AGTGTNGGCC NTCTGTACTC TGGCTGCAGA CTGACCTNNC
58601  TCAGGNCNGA GAAGNATGGN GCAGCCACTG GANTGGATGC CATCTGCANC
58651  CACCNNCNTN ANCCCAAAAG NCCTGGACTG NACAGNGAGC NGCTNTACTG
58701  GGAGCTNAGC CANCTGACCA ANNNCATCNN NGAGCTGGGN CCCTACACCC
58751  TGGACAGGNA CAGTCTCTAT GTCAATGGTT TCACCCATCG GAGCTTTGGG
58801  CTCACCACCA GCACTCCTTG GACTTCCACA GTTGACCTTG GAACCTCAGG
58851  GACTCCATCC CCCGTCCCCA GCCCACAAC TGCTGGCCCT CTCCTGGTGC
58901  CATTCACCCT AAACTTCACC ATCACCAACC TGCAGTATGA GGAGGACATG
58951  CATCGCCCTG GCTCCAGGAA GTTCAACACC ACGGAGAGGG TCCTTCAGGG
59001  TCTGCTTACG CCCTTGTTCA GGAACACCAG TGTCAGCTCT CTGTACTCTG
59051  GTTGCAGACT GACCTTGCTC AGGCCTGAGA AGGATGGGGC AGCCACCAGA
59101  GTGGATGCTG TCTGCACCCA TCGTCCTGAC CCCAAAAGCC CTGGACTGNA
59151  CAGNGAGCNG CTNTACTGGG AGCTNAGCCA NCTGACCAAN NNCATCNNNG
59201  AGCTGGGNCC CTACACCCTG GACAGGNACA GTCTCTATGT CAATGGTTTC
59251  ACCCATCNGA NCTCTGNGCC CACCACCAGC ACTCCTGGGA CCTCCACAGT
59301  GNACNTNGGN ACCTCNGGGA CTCCATCCTC CNTCCCCNGC CNCACANCNN
59351  CTGNCCCTCT CCTGNTNCCN TTCACCNTCA ACTTNACCAT CACCAACCTG
59401  CANTANGNGG ANNACATGCN NCNCCCNGGN TCCAGGAAGT TCAACACCAC
59451  NGAGNGNGTN CTGCAGGGTC TGCTNNNNCC CNTNTTCAAG AACNCCAGTG
59501  TNGGCCNTCT GTACTCTGGC TGCAGACTGA CCTNNCTCAG GNCNGAGAAG
59551  NATGGNGCAG CCACTGGANT GGATGCCATC TGCANCCACC NNCNTNANCC
59601  CAAAAGNCCT GGACTGNACA GNGAGCNGCT NTACTGGGAG CTNAGCCANC
59651  TGACCAANNN CATCNNNGAG CTGGGNCCCT ACACCCTGGA CAGGNACAGT
59701  CTCTATGTCA ATGGTTTCAC CCATTGGATC CCTGTGCCCA CCAGCAGCAC
59751  TCCTGGGACC TCCACAGTGG ACCTTGGGTC AGGGACTCCA TCCTCCCTCC
59801  CCAGCCCCAC AACTGCTGGC CCTCTCCTGG TACCATTCAC CCTCAACTTC
59851  ACCATCACCA ACCTGCAGTA TGGGAGGAC ATGGGTCACC CTGGCTCCAG
59901  GAAGTTCAAC ACCACAGAGA GGGTCCTGCA GGGTCTGCTT GGTCCCATAT
```

TABLE 30-continued

Human cDNA of CA125
(SEQ ID NO: 314)

```
59951  TCAAGAACAC CAGTGTTGGC CCTCTGTACT CTGGCTGCAG ACTGACCTCT
60001  CTCAGGTCCG AGAAGGATGG AGCAGCCACT GGAGTGGATG CCATCTGCAT
60051  CCATCATCTT GACCCCAAAA GCCCTGGACT GNACAGNGAG CNGCTNTACT
60101  GGGAGCTNAG CCANCTGACC AANNNCATCN NNGAGCTGGG NCCCTACACC
60151  CTGGACAGGN ACAGTCTCTA TGTCAATGGT TTCACCCATC NGANCTCTGN
60201  GCCCACCACC AGCACTCCTG GGACCTCCAC AGTGNACNTN GGNACCTCNG
60251  GGACTCCATC CTCCNTCCCC NGCCNCACAN CNNCTGNCCC TCTCCTGNTN
60301  CCNTTCACCN TCAACTTNAC CATCACCAAC CTGCANTANG NGGANNACAT
60351  GCNNCNCCCN GGNTCCAGGA AGTTCAACAC CACNGAGNGN GTNCTGCAGG
60401  GTCTGCTNNN NCCCNTNTTC AAGAACNCCA GTGTNGGCCN TCTGTACTCT
60451  GGCTGCAGAC TGACCTNNCT CAGGNCNGAG AAGNATGGNG CAGCCACTGG
60501  ANTGGATGCC ATCTGCANCC ACCNNCNTNA NCCCAAAAGN CCTGGACTGN
60551  ACAGNGAGCN GCTNTACTGG GAGCTNAGCC ANCTGACCAA NNNCATCNNN
60601  GAGCTGGGNC CCTACACCCT GGACAGGNAC AGTCTCTATG TCAATGGTTT
60651  CACCCATCAG ACCTTTGCGC CCAACACCAG CACTCCTGGG ACCTCCACAG
60701  TGGACCTTGG GACCTCAGGG ACTCCATCCT CCCTCCCCAG CCCTACATCT
60751  GCTGGCCCTC TCCTGGTGCC ATTCACCCTC AACTTCACCA TCACCAACCT
60801  GCAGTACGAG GAGGACATGC ATCACCCAGG CTCCAGGAAG TTCAACACCA
60851  CGGAGCGGGT CCTGCAGGGT CTGCTTGGTC CCATGTTCAA GAACACCAGT
60901  GTCGGCCTTC TGTACTCTGG CTGCAGACTG ACCTTGCTCA GGCCTGAGAA
60951  GAATGGGGCA GCCACCAGAG TGGATGCTGT CTGCACCCAT CGTCCTGACC
61001  CCAAAAGCCC TGGACTGNAC AGNGAGCNGC TNTACTGGGA GCTNAGCCAN
61051  CTGACCAANN NCATCNNNGA GCTGGGNCCC TACACCCTGG ACAGGNACAG
61101  TCTCTATGTC AATGGTTTCA CCCATCNGAN CTCTGNGCCC ACCACCAGCA
61151  CTCCTGGGAC CTCCACAGTG NACNTGGNA CCTCNGGGAC TCCATCCTCC
61201  NTCCCCNGCC NCACAGCCCC TGTCCCTCTC TTGATACCAT TCACCCTCAA
61251  CTTTACCATC ACCAACCTGC ATTATGAAGA AAACATGCAA CACCCTGGTT
61301  CCAGGAAGTT CAACACCACG GAGAGGGTTC TGCAGGGTCT GCTCAAGCCC
61351  TTGTTCAAGA GCACCAGCGT TGGCCCTCTG TACTCTGGCT GCAGACTGAC
61401  CTTGCTCAGA CCTGAGAAAC ATGGGGCAGC CACTGGAGTG GACGCCATCT
61451  GCACCCTCCG CCTTGATCCC ACTGGTCCTG GACTGGACAG AGAGCGGCTA
61501  TACTGGGAGC TGAGCCAGCT GACCAACAGC GTTACAGAGC TGGGCCCCTA
61551  CACCCTGGAC AGGGACAGTC TCTATGTCAA TGGCTTCACC CAGCGGAGCT
61601  CTGTGCCAAC CACCAGTATT CTGGGACCT CTGCAGTGCA CCTGGAAACC
61651  TCTGGGACTC CAGCCTCCCT CCCTGGCCAC ACAGCCCCTG GCCCTCTCCT
61701  GGTGCCATTC ACCCTCAACT TCACTATCAC CAACCTGCAG TATGAGGTGG
61751  ACATGCGTCA CCCTGGTTCC AGGAAGTTCA ACACCACGGA GAGTCCTG
61801  CAGGGTCTGC TCAAGCCCTT GTTCAAGAGC ACCAGTGTTG CCCTCTGTA
```

TABLE 30-continued

Human cDNA of CA125
(SEQ ID NO: 314)

```
61851  CTCTGGCTGC AGACTGACCT TGCTCAGGCC TGAAAAACGT GGGGCAGCCA
61901  CCGGCGTGGA CACCATCTGC ACTCACCGCC TTGACCCTCT AAACCCTGGA
61951  CTGGACAGAG AGCAGCTATA CTGGGAGCTG AGCAAACTGA CCCGTGGCAT
62001  CATCGAGCTG GCCCCTACC  TCCTGGACAG AGGCAGTCTC TATGTCAATG
62051  GTTTCACCCA TCGGAACTTT GTGCCCATCA CCAGCACTCC TGGGACCTCC
62101  ACAGTACACC TAGGAACCTC TGAAACTCCA TCCTCCCTAC CTAGACCCAT
62151  AGTGCCTGGC CCTCTCCTGG TGCCATTCAC CCTCAACTTC ACCATCACCA
62201  ACTTGCAGTA TGAGGAGGCC ATGCGACACC CTGGCTCCAG GAAGTTCAAT
62251  ACCACGGAGA GGGTCCTACA GGGTCTGCTC AGGCCCTTGT TCAAGAATAC
62301  CAGTATCGGC CCTCTGTACT CCAGCTGCAG ACTGACCTTG CTCAGGCCAG
62351  AGAAGGACAA GGCAGCCACC AGAGTGGATG CCATCTGTAC CCACCACCCT
62401  GACCCTCAAA GCCCTGGACT GAACAGAGAG CAGCTGTACT GGGAGCTGAG
62451  CCAGCTGACC CACGGCATCA CTGAGCTGGG CCCCTACACC CTGGACAGGG
62501  ACAGTCTCTA TGTCGATGGT TTCACTCATT GGAGCCCCAT ACCGACCACC
62551  AGCACTCCTG GGACCTCCAT AGTGAACCTG GAACCTCTG  GGATCCCACC
62601  TTCCCTCCCT GAAACTACAN CNNCTGNCCC TCTCCTGNTN CCNTTCACCN
62651  TCAACTTNAC CATCACCAAC CTGCANTANG NGGANNACAT GCNNCNCCCN
62701  GGNTCCAGGA AGTTCAACAC CACNGAGAGG GTTCTGCAGG GTCTGCTCAA
62751  GCCCTTGTTC AAGAGCACCA GTGTTGGCCC TCTGTATTCT GGCTGCAGAC
62801  TGACCTTGCT CAGGCCTGAG AAGGACGGAG TAGCCACCAG AGTGGACGCC
62851  ATCTGCACCC ACCGCCCTGA CCCCAAAATC CCTGGGCTAG ACAGACAGCA
62901  GCTATACTGG GAGCTGAGCC AGCTGACCCA CAGCATCACT GAGCTGGGAC
62951  CCTACACCCT GGATAGGGAC AGTCTCTATG TCAATGGTTT CACCCAGCGG
63001  AGCTCTGTGC CCACCACCAG CACTCCTGGG ACTTTCACAG TACAGCCGGA
63051  AACCTCTGAG ACTCCATCAT CCCTCCCTGG CCCCACAGCC ACTGGCCCTG
63101  TCCTGCTGCC ATTCACCCTC AATTTTACCA TCACTAACCT GCAGTATGAG
63151  GAGGACATGC ATCGCCCTGG CTCCAGGAAG TTCAACACCA CGGAGAGGGT
63201  CCTTCAGGGT CTGCTTATGC CCTTGTTCAA GAACACCAGT GTCAGCTCTC
63251  TGTACTCTGG TTGCAGACTG ACCTTGCTCA GGCCTGAGAA GGATGGGGCA
63301  GCCACCAGAG TGGATGCTGT CTGCACCCAT CGTCCTGACC CCAAAAGCCC
63351  TGGACTGGAC AGAGAGCGGC TGTACTGGAA GCTGAGCCAG CTGACCCACG
63401  GCATCACTGA GCTGGGCCCC TACACCCTGG ACAGGCACAG TCTCTATGTC
63451  AATGGTTTCA CCCATCAGAG CTCTATGACG ACCACCAGAA CTCCTGATAC
63501  CTCCACAATG CACCTGGCAA CCTCGAGAAC TCCAGCCTCC CTGTCTGGAC
63551  CTACGACCGC CAGCCCTCTC CTGGTGCTAT TCACAATTAA CTTCACCATC
63601  ACTAACCTGC GGTATGAGGA GAACATGCAT CACCCTGGCT CTAGAAAGTT
63651  TAACACCACG GAGAGAGTCC TTCAGGGTCT GCTCAGGCCT GTGTTCAAGA
63701  ACACCAGTGT TGGCCCTCTG TACTCTGGCT GCAGACTGAC CTTGCTCAGG
63751  CCCAAGAAGG ATGGGGCAGC CACCAAAGTG GATGCCATCT GCACCTACCG
```

TABLE 30-continued

Human cDNA of CA125
(SEQ ID NO: 314)

```
63801  CCCTGATCCC AAAAGCCCTG GACTGGACAG AGAGCAGCTA TACTGGGAGC

63851  TGAGCCAGCT AACCCACAGC ATCACTGAGC TGGGCCCCTA CACCCTGGAC

63901  AGGGACAGTC TCTATGTCAA TGGTTTCACA CAGCGGAGCT CTGTGCCCAC

63951  CACTAGCATT CCTGGGACCC CCACAGTGGA CCTGGGAACA TCTGGGACTC

64001  CAGTTTCTAA ACCTGGTCCC TCGGCTGCCA GCCCTCTCCT GGTGCTATTC

64051  ACTCTCAACT TCACCATCAC CAACCTGCGG TATGAGGAGA ACATGCAGCA

64101  CCCTGGCTCC AGGAAGTTCA ACACCACGGA GAGGGTCCTT CAGGGCCTGC

64151  TCAGGTCCCT GTTCAAGAGC ACCAGTGTTG GCCCTCTGTA CTCTGGCTGC

64201  AGACTGACTT TGCTCAGGCC TGAAAAGGAT GGGACAGCCA CTGGAGTGGA

64251  TGCCATCTGC ACCCACCACC CTGACCCCAA AAGCCCTAGG CTGGACAGAG

64301  AGCAGCTGTA TTGGGAGCTG AGCCAGCTGA CCCACAATAT CACTGAGCTG

64351  GGCCACTATG CCCTGGACAA CGACAGCCTC TTTGTCAATG GTTTCACTCA

64401  TCGGAGCTCT GTGTCCACCA CCAGCACTCC TGGGACCCCC ACAGTGTATC

64451  TGGGAGCATC TAAGACTCCA GCCTCGATAT TTGGCCCTTC AGCTGCCAGC

64501  CATCTCCTGA TACTATTCAC CCTCAACTTC ACCATCACTA ACCTGCGGTA

64551  TGAGGAGAAC ATGTGGCCTG GCTCCAGGAA GTTCAACACT ACAGAGAGGG

64601  TCCTTCAGGG CCTGCTAAGG CCCTTGTTCA AGAACACCAG TGTTGGCCCT

64651  CTGTACTCTG GCTCCAGGCT GACCTTGCTC AGGCCAGAGA AGATGGGGA

64701  AGCCACCGGA GTGGATGCCA TCTGCACCCA CCGCCCTGAC CCCACAGGCC

64751  CTGGGCTGGA CAGAGAGCAG CTGTATTTGG AGCTGAGCCA GCTGACCCAC

64801  AGCATCACTG AGCTGGGCCC CTACACACTG GACAGGGACA GTCTCTATGT

64851  CAATGGTTTC ACCCATCGGA GCTCTGTACC CACCACCAGC ACCGGGGTGG

64901  TCAGCGAGGA GCCATTCACA CTGAACTTCA CCATCAACAA CCTGCGCTAC

64951  ATGGCGGACA TGGGCCAACC CGGCTCCCTC AAGTTCAACA TCACAGACAA

65001  CGTCATGAAG CACCTGCTCA GTCCTTTGTT CCAGAGGAGC AGCCTGGGTG

65051  CACGGTACAC AGGCTGCAGG GTCATCGCAC TAAGGTCTGT GAAGAACGGT

65101  GCTGAGACAC GGGTGGACCT CCTCTGCACC TACCTGCAGC CCCTCAGCGG

65151  CCCAGGTCTG CCTATCAAGC AGGTGTTCCA TGAGCTGAGC CAGCAGACCC

65201  ATGGCATCAC CCGGCTGGGC CCCTACTCTC TGGACAAAGA CAGCCTCTAC

65251  CTTAACGGTT ACAATGAACC TGGTCTAGAT GAGCCTCCTA CAACTCCCAA

65301  GCCAGCCACC ACATTCCTGC CTCCTCTGTC AGAAGCCACA ACAGCCATGG

65351  GGTACCACCT GAAGACCCTC ACACTCAACT TCACCATCTC CAATCTCCAG

65401  TATTCACCAG ATATGGGCAA GGGCTCAGCT ACATTCAACT CCACCGAGGG

65451  GGTCCTTCAG CACCTGCTCA GACCCTTGTT CCAGAAGAGC AGCATGGGCC

65501  CCTTCTACTT GGGTTGCCAA CTGATCTCCC TCAGGCCTGA GAAGGATGGG

65551  GCAGCCACTG GTGTGGACAC CACCTGCACC TACCACCCTG ACCCTGTGGG

65601  CCCCGGGCTG GACATACAGC AGCTTTACTG GGAGCTGAGT CAGCTGACCC

65651  ATGGTGTCAC CCAACTGGGC TTCTATGTCC TGGACAGGGA TAGCCTCTTC
```

TABLE 30-continued

Human cDNA of CA125
(SEQ ID NO: 314)

```
65701  ATCAATGGCT ATGCACCCCA GAATTTATCA ATCCGGGGCG AGTACCAGAT
65751  AAATTTCCAC ATTGTCAACT GGAACCTCAG TAATCCAGAC CCCACATCCT
65801  CAGAGTACAT CACCCTGCTG AGGGACATCC AGGACAAGGT CACCACACTC
65851  TACAAAGGCA GTCAACTACA TGACACATTC CGCTTCTGCC TGGTCACCAA
65901  CTTGACGATG GACTCCGTGT TGGTCACTGT CAAGGCATTG TTCTCCTCCA
65951  ATTTGGACCC CAGCCTGGTG GAGCAAGTCT TTCTAGATAA GACCCTGAAT
66001  GCCTCATTCC ATTGGCTGGG CTCCACCTAC CAGTTGGTGG ACATCCATGT
66051  GACAGAAATG GAGTCATCAG TTTATCAACC AACAAGCAGC TCCAGCACCC
66101  AGCACTTCTA CCTGAATTTC ACCATCACCA ACCTACCATA TTCCCAGGAC
66151  AAAGCCCAGC CAGGCACCAC CAATTACCAG AGGAACAAAA GGAATATTGA
66201  GGATGCGCTC AACCAACTCT TCCGAAACAG CAGCATCAAG AGTTATTTTT
66251  CTGACTGTCA AGTTTCAACA TTCAGGTCTG TCCCCAACAG GCACCACACC
66301  GGGGTGGACT CCCTGTGTAA CTTCTCGCCA CTGGCTCGGA GAGTAGACAG
66351  AGTTGCCATC TATGAGGAAT TTCTGCGGAT GACCCGGAAT GGTACCCAGC
66401  TGCAGAACTT CACCCTGGAC AGGAGCAGTG TCCTTGTGGA TGGGTATTCT
66451  CCCAACAGAA ATGAGCCCTT AACTGGGAAT TCTGACCTTC CCTTCTGGGC
66501  TGTCATCCTC ATCGGCTTGG CAGGACTCCT GGGACTCATC ACATGCCTGA
66551  TCTGCGGTGT CCTGGTGACC ACCCGCCGGC GGAAGAAGGA AGGAGAATAC
66601  AACGTCCAGC AACAGTGCCC AGGCTACTAC CAGTCACACC TAGACCTGGA
66651  GGATCTGCAA TGACTGGAAC TTGCCGGTGC CTGGGGTGCC TTTCCCCCAG
66701  CCAGGGTCCA AGAAGCTTG GCTGGGCAG AATAAACCA TATTGGTCGG
66751  AAAAAAAAAA AAAAA
```

TABLE 31

Human Protein of CA125 Molecule
(SEQ ID NO: 315)

```
  1  MLKPSGLPGS SSPTRSLMTG SRSTKATPEM DSGLTGATLS PKTSTGAIVV
 51  TEHTLPFTSP DKTLASPTSS VVGRTTQSLG VMSSALPEST SRGMTHSEQR
101  TSPSLSPQVN GTPSRNYPAT SMVSGLSSPR TRTSSTEGNF TKEASTYTLT
151  VETTSGPVTE KYTVPTETST TEGDSTETPW DTRYIPVKIT SPMKTFADST
201  ASKENAPVSM TPAETTVTDS HTPGRTNPSF GTLYSSFLDL SPKGTPNSRG
251  ETSLELILST TGYPFSSPEP GSAGHSRIST SAPLSSSASV LDNKISETSI
301  FSGQSLTSPL SPGVPEARAS TMPNSAIPFS MTLSNAETSA ERVRSTISSL
351  GTPSISTKQT AETILTFHAF AETMDIPSTH IAKTLASEWL GSPGTLGGTS
401  TSALTTTSPS TTLVSEETNT HHSTSGKETE GTLNTSMTPL ETSAPGEESE
451  MTATLVPTLG FTTLDSKIRS PSQVSSSHPT RELRTTGSTS GRQSSSTAAH
501  GSSDILRATT SSTSKASSWT SESTAQQFSE PQHTQWVETS PSMKTERPPA
551  STSVAAPITT SVPSVVSGFT TLKTSSTKGI WLEETSADTL IGESTAGPTT
601  HQFAVPTGIS MTGGSSTRGS QGTTHLLTRA TASSETSADL TLATNGVPVS
```

TABLE 31-continued

Human Protein of CA125 Molecule
(SEQ ID NO: 315)

```
 651  VSPAVSKTAA GSSPPGGTKP SYTMVSSVIP ETSSLQSSAF REGTSLGLTP

701  LNTRHPFSSP EPDSAGHTKI STSIPLLSSA SVLEDKVSAT STFSHHKATS

751  SITTGTPEIS TKTKPSSAVL SSMTLSNAAT SPERVRNATS PLTHPSPSGE

801  ETAGSVLTLS TSAETTDSPN IHPTGTLTSE SSESPSTLSL PSVSGVKTTF

851  SSSTPSTHLF TSGEETEETS NPSVSQPETS VSRVRTTLAS TSVPTPVFPT

901  MDTWPTRSAQ FSSSHLVSEL RATSSTSVTN STGSALPKIS HLTGTATMSQ

951  TNRDTFNDSA APQSTTWPET SPRFKTGLPS ATTTVSTSAT SLSATVMVSK

1001  FTSPATSSME ATSIREPSTT ILTTETTNGP GSMAVASTNI PIGKGYITEG

1051  RLDTSHLPIG TTASSETSMD FTMAKESVSM SVSPSQSMDA AGSSTPGRTS

1101  QFVDTFSDDV YHLTSREITI PRDGTSSALT PQMTATHPPS PDPGSARSTW

1151  LGILSSSPSS PTPKVTMSST FSTQRVTTSM IMDTVETSRW NMPNLPSTTS

1201  LTPSNIPTSG AIGKSTLVPL DTPSPATSLE ASEGGLPTLS TYPESTNTPS

1251  IHLGAHASSE SPSTINLTMA SVVKPGSYTP LTFPSIETHI HVSTARMAYS

1301  SGSSPEMTAP GETNTGSTWD PTTYITTTDP KDTSSAQVST PHSVRTLRTT

1351  ENHPKTESAT PAAYSGSPKI SSSPNLTSPA TKAWTITDTT EHSTQLHYTK

1401  LAEKSSGFET QSAPGPVSVV IPTSPTIGSS TLELTSDVPG EPLVLAPSEQ

1451  TTITLPMATW LSTSLTEEMA STDLDISSPS SPMSTFAIFP PMSTPSHELS

1501  KSEADTSAIR NTDSTTLDQH LGIRSLGRTG DLTTVPITPL TTTWTSVIEH

1551  STQAQDTLSA TMSPTHVTQS LKDQTSIPAS ASPSHLTEVY PELGTQGRSS

1601  SEATTFWKPS TDTLSREIET GPTNIQSTPP MDNTTTGSSS SGVTLGIAHL

1651  PIGTSSPAET STNMALERRS STATVSMAGT MGLLVTSAPG RSISQSLGRV

1701  SSVLSESTTE GVTDSSKGSS PRLNTQGNTA LSSSLEPSYA EGSQMSTSIP

1751  LTSSPTTPDV EFIGGSTFWT KEVTTVMTSD ISKSSARTES SSATLMSTAL

1801  GSTENTGKEK LRTASMDLPS PTPSMEVTPW ISLTLSNAPN TTDSLDLSHG

1851  VHTSSAGTLA TDRSLNTGVT RASRLENGSD TSSKSLSMGN STHTSMDTTE

1901  KSEVSSSIHP RPETSAPGAE TTLTSTPGNR AISLTLPFSS IPVEEVISTG

1951  ITSGPDINSA PMTHSPITPP TIVWTSTGTI EQSTQPLHAV SSEKVSVQTQ

2001  STPYVNSVAV SASPTHENSV SSGSSTSSPY SSASLESLDS TISRRNAITS

2051  WLWDLTTSLP TTTWPSTSLS EALSSGHSGV SNPSSTTTEF PLFSAASTSA

2101  AKQRNPETET HGPQNTAAST LNTDASSVTG LSETPVGASI SSEVPLPMAI

2151  TSRSDVSGLT SESTANPSLG TASSAGTKLT RTISLPTSES LVSFRMNKDP

2201  WTVSIPLGSH PTTNTETSIP VNSAGPPGLS TVASDVIDTP SDGAESIPTV

2251  SFSPSPDTEV TTISHFPEKT THSFRTISSL THELTSRVTP IPGDWMSSAM

2301  STKPTGASPS ITLGERRTIT SAAPTTSPIV LTASFTETST VSLDNETTVK

2351  TSDILDARKT NELPSDSSSS SDLINTSIAS STMDVTKTAS ISPTSISGMT

2401  ASSSPSLFSS DRPQVPTSTT ETNTATSPSV SSNTYSLDGG SNVGGTPSTL

2451  PPFTITHPVE TSSALLAWSR PVRTFSTMVS TDTASGENPT SSNSVVTSVP

2501  APGTWASVGS TTDLPAMGFL KTSPAGEAHS LLASTIEPAT AFTPHLSAAV
```

TABLE 31-continued

Human Protein of CA125 Molecule
(SEQ ID NO: 315)

```
2551  VTGSSATSEA SLLTTSESKA IHSSPQTPTT PTSGANWETS ATPESLLVVT

2601  ETSDTTLTSK ILVTDTILFS TVSTPPSKFP STGTLSGASF PTLLPDTPAI

2651  PLTATEPTSS LATSFDSTPL VTIASDSLGT VPETTLTMSE TSNGDALVLK

2701  TVSNPDRSIP GITIQGVTES PLHPSSTSPS KIVAPRNTTY EGSITVALST

2751  LPAGTTGSLV FSQSSENSET TALVDSSAGL ERASVMPLTT GSQGMASSGG

2801  IRSGSTHSTG TKTFSSLPLT MNPGEVTAMS EITTNRLTAT QSTAPKGIPV

2851  KPTSAESGLL TPVSASSSPS KAFASLTTAP PSTWGIPQST LTFEFSEVPS

2901  LDTKSASLPT PGQSLNTIPD SDASTASSSL SKSPEKNPRA RMMTSTKAIS

2951  ASSFQSTGFT ETPEGSASPS MAGHEPRVPT SGTGDPRYAS ESMSYPDPSK

3001  ASSAMTSTSL ASKLTTLFST GQAARSGSSS SPISLSTEKE TSFLSPTAST

3051  SRKTSLFLGP SMARQPNILV HLQTSALTLS PTSTLNMSQE EPPELTSSQT

3101  IAEEEGTTAE TQTLTFTPSE TPTSLLPVSS PTEPTARRKS SPETWASSIS

3151  VPAKTSLVET TDGTLVTTIK MSSQAAQGNS TWPAPAEETG TSPAGTSPGS

3201  PEVSTTLKIM SSKEPSISPE IRSTVRNSPW KTPETTVPME TTVEPVTLQS

3251  TALGSGSTSI SHLPTGTTSP TKSPTENMLA TERVSLSPSP PEAWTNLYSG

3301  TPGGTRQSLA TMSSVSLESP TARSITGTGQ QSSPELVSKT TGMEFSMWHG

3351  STGGTTGDTH VSLSTSSNIL EDPVTSPNSV SSLTDKSKHK TETWVSTTAI

3401  PSTVLNNKIM AAEQQTSRSV DEAYSSTSSW SDQTSGSDIT LGASPDVTNT

3451  LYITSTAQTT SLVSLPSGDQ GITSLTNPSG GKTSSASSVT SPSIGLETLR

3501  ANVSAVKSDI APTAGHLSQT SSPAEVSILD VTTAPTPGIS TTITTMGTNS

3551  ISTTTPNPEV GMSTMDSTPA TERRTTSTEH PSTWSSTAAS DSWTVTDMTS

3601  NLKVARSPGT ISTMHTTSFL ASSTELDSMS TPHGRITVIG TSLVTPSSDA

3651  SAVKTETSTS ERTLSPSDTT ASTPISTFSR VQRMSISVPD ILSTSWTPSS

3701  TEAEDVPVSM VPTDHASTKT DPNTPLSTFL FDSLSTLDWD TGRSLSSATA

3751  TTSAPQGATT PQELTLETMI SPATSQLPFS IGHITSAVTP AAMARSSGVT

3801  FSRPDPTSKK AEQTSTQLPT TTSAHPGQVP RSAATTLDVI PHTAKTPDAT

3851  FQRQGQTALT TEARATSDSW NEKEKSTPSA PWITEMMNSV SEDTIKEVTS

3901  SSSVLKDPEY AGHKLGIWDD FIPKFGKAAH MRELPLLSPP QDKEAIHPST

3951  NTVETTGWVT SSEHASHSTI PAHSASSKLT SPVVTTSTRE QAIVSMSTTT

4001  WPESTRARTE PNSFLTIELR DVSPYMDTSS TTQTSIISSP GSTAITKGHR

4051  TEITSYKRIS SSFLAQSMRS SDSPSEAITR LSNFPAMTES GGMILAMQTS

4101  PPGATSISAP TLDTSATASW TGTPLATTQR FTYSEKTTLF SKGREDTSQP

4151  SPPCVEETSS SSSVVPIHAT TSPSNILLTS QGHSPSSTPP VTSVFLSETS

4201  GLGKTTDMSR ISLEPGTSLP PNLSSTAGEA LSTYEASRDT KAIHHSADTA

4251  VTNMEATSSE YSPIPGHTKP SKATSPLVTS HIMGDITSST SVFGSSETTE

4301  IETVSSVNQG LQERSTSQVA SSATETSTVI THVSSGDATT HVTKTQATFS

4351  SGTSISSSPHQ FITSTNTFTD VSTNPSTSLI MTESSGVTIT TQTGPTGAAT

4401  QGPYLLDTST MPYLTETPLA VTPDFMQSEK TTLISKGPKD VTWTSPPSVA

4451  ETSYPSSLTP FLVTTIPPAT STLQGQHTSS PVSATSVLTS GLVKTTDMLN
```

TABLE 31-continued

Human Protein of CA125 Molecule
(SEQ ID NO: 315)

```
4501  TSMEPVTNSP QNLNNPSNEI LATLAATTDI ETIHPSINKA VTNMGTASSA

4551  HVLHSTLPVS SEPSTATSPM VPASSMGDAL ASISIPGSET TDIEGEPTSS

4601  LTAGRKENST LQEMNSTTES NIILSNVSVG AITEATKMEV PSFDATFIPT

4651  PAQSTKFPDI FSVASSRLSN SPPMTISTHM TTTQTGSSGA TSKIPLALDT

4701  STLETSAGTP SVVTEGFAHS KITTAMNNDV KDVSQTNPPF QDEASSPSSQ

4751  APVLVTTLPS SVAFTPQWHS TSSPVSMSSV LTSSLVKTAG KVDTSLETVT

4801  SSPQSMSNTL DDISVTSAAT TDIETTHPSI NTVVTNVGTT GSAFESHSTV

4851  SAYPEPSKVT SPNVTTSTME DTTISRSIPK SSKTTRTETE TTSSLTPKLR

4901  ETSISQEITS STETSTVPYK ELTGATTEVS RTDVTSSSST SFPGPDQSTV

4951  SLDISTETNT RLSTSPIMTE SAEITITTQT GPHGATSQDT FTMDPSNTTP

5001  QAGIHSAMTH GFSQLDVTTL MSRIPQDVSW TSPPSVDKTS SPSSFLSSPA

5051  MTTPSLISST LPEDKLSSPM TSLLTSGLVK ITDILRTRLE PVTSSLPNFS

5101  STSDKILATS KDSKDTKEIF PSINTEETNV KANNSGHESH SPALADSETP

5151  KATTQMVITT TVGDPAPSTS MPVHGSSETT NIKREPTYFL TPRLRETSTS

5201  QESSFPTDTS FLLSKVPTGT ITEVSSTGVI SSSKISTPDH DKSTVPPDTF

5251  TGEIPRVFTS SIKTKSAEMT ITTQASPPES ASHSTLPLDT STTLSQGGTH

5301  STVSQGFPYS EVTTLMGMGP GNVSWMTTPP VEETSSVSSL MSSPAMTSPS

5351  PVSSTSPQSI PSSPLPVTAL PTSVLVTTTD VLGTTSPESV TSSPPNLSSI

5401  THERPATYKD TAHTEAAMHH STNTAVTNVG TSGSGHKSQS SVLADSETSK

5451  ATPLMSTAST LGDTSVSTST PNISQTNQIQ TEPTASLSPR LRESSTSEKT

5501  SSTTETNTAF SYVPTGAITQ ASRTEISSSR TSISDLDRST IAPDISTGMI

5551  TRLFTSPIMT KSAEMTVTTQ TTTPGATSQG ILPWDTSTTL FQGGTHSTVS

5601  QGFPHSEITT LRSRTPGDVS WMTTPPVEET SSGFSLMSPS MTSPSPVSST

5651  SPESIPSSPL PVTALLTSVL VTTTNVLGTT SPEPVTSSPP NLSSPTQERL

5701  TTYKDTAHTE AMHASMHTNT AVANVGTSIS GHESQSSVPA DSHTSKATSP

5751  MGITFAMGDT SVYTSTPAFF ETRIQSESTS SLIPGLRDTR TSEEINTVTE

5801  TSTVLSEVPT TTTTEVSRTE VITSSRTTIS GPDHSKMSPY ISTETITRLS

5851  TFPFVTGSTE MAITNQTGPI GTISQATLTL DTSSTASWEG THSPVTQRFP

5901  HSEETTTMSR STKGVSWQSP PSVEETSSPS SPVPLPAITS HSSLYSAVSG

5951  SSPTSALPVT SLLTSGRRKT IDMLDTHSEL VTSSLPSASS FSGEILTSEA

6001  STNTETIHFS ENTAETNMGT TNSMHKLHSS VSIHSQPSGH TPPKVTGSMM

6051  EDAIVSTSTP GSPETKNVDR DSTSPLTPEL KEDSTALVMN STTESNTVFS

6101  SVSLDAATEV SRAEVTYYDP TFMPASAQST KSPDISPEAS SSHSNSPPLT

6151  ISTHKTIATQ TGPSGVTSLG QLTLDTSTIA TSAGTPSART QDFVDSETTS

6201  VMNNDLNDVL KTSPFSAEEA NSLSSQAPLL VTTSPSPVTS TLQEHSTSSL

6251  VSVTSVPTPT LAKITDMDTN LEPVTRSPQN LRNTLATSEA TTDTHTMHPS

6301  INTAMANVGT TSSPNEFYFT VSPDSDPYKA TSAVVITSTS GDSIVSTSMP

6351  RSSAMKKIES ETTFSLIFRL RETSTSQKIG SSSDTSTVFD KAFTAATTEV
```

TABLE 31-continued

Human Protein of CA125 Molecule
(SEQ ID NO: 315)

```
6401  SRTELTSSSR TSIQGTEKPT MSPDTSTRSV TMLSTFAGLT KSEERTIATQ

6451  TGPHRATSQG TLTWDTSITT SQAGTHSAMT HGFSQLDLST LTSRVPEYIS

6501  GTSPPSVEKT SSSSSLLSLP AITSPSPVPT TLPESRPSSP VHLTSLPTSG

6551  LVKTTDMLAS VASLPPNLGS TSHKIPTTSE DIKDTEKMYP STNIAVTNVG

6601  TTTSEKESYS SVPAYSEPPK VTSPMVTSFN IRDTIVSTSM PGSSEITRIE

6651  MESTFSLAHG LKGTSTSQDP IVSTEKSAVL HKLTTGATET SRTEVASSRR

6701  TSIPGPDHST ESPDISTEVI PSLPISLGIT ESSNMTIITR TGPPLGSTSQ

6751  GTFTLDTPTT SSRAGTHSMA TQEFPHSEMT TVMNKDPEIL SWTIPPSIEK

6801  TSFSSSLMPS PAMTSPPVSS TLPKTIHTTP SPMTSLLTPS LVMTTDTLGT

6851  SPEPTTSSPP NLSSTSHVIL TTDEDTTAIE AMHPSTSTAA TNVETTCSGH

6901  GSQSSVLTDS EKTKATAPMD TTSTMGHTTV STSMSVSSET TKIKRESTYS

6951  LTPGLRETSI SQNASFSTDT SIVLSEVPTG TTAEVSRTEV TSSGRTSIPG

7001  PSQSTVLPEI STRTMTRLFA SPTMTESAEM TIPTQTGPSG STSQDTLTLD

7051  TSTTKSQAKT HSTLTQRFPH SEMTTLMSRG PGDMSWQSSP SLENPSSLPS

7101  LLSLPATTSP PPISSTLPVT ISSSPLPVTS LLTSSPVTTT DMLHTSPELV

7151  TSSPPKLSHT SDERLTTGKD TTNTEAVHPS TNTAASNVEI PSFGHESPSS

7201  ALADSETSKA TSPMFITSTQ EDTTVAISTP HFLETSRIQK ESISSLSPKL

7251  RETGSSVETS SAIETSAVLS EVSIGATTEI SRTEVTSSSR TSISGSAEST

7301  MLPEISTTRK IIKFPTSPIL AESSEMTIKT QTSPPGSTSE STFTLDTSTT

7351  PSLVITHSTM TQRLPHSEIT TLVSRGAGDV PRPSSLPVEE TSPPSSQLSL

7401  SAMISPSPVS STLPASSHSS SASVTSPLTP GQVKTTEVLD ASAEPETSSP

7451  PSLSSTSVEI LATSEVTTDT EKIHPFPNTA VTKVGTSSSG HESPSSVLPD

7501  SETTKATSAM GTISIMGDTS VSTLTPALSN TRKIQSEPAS SLTTRLRETS

7551  TSEETSLATE ANTVLSKVST GATTEVSRTE AISFSRTSMS GPEQSTMSQD

7601  ISIGTIPRIS ASSVLTESAK MTITTQTGPS ESTLESTLNL NTATTPSWVE

7651  THSIVIQGFP HPEMTTSMGR GPGGVSWPSP PFVKETSPPS SPLSLPAVTS

7701  PHPVSTTFLA HIPPSPLPVT SLLTSGPATT TDILGTSTEP GTSSSSSLST

7751  TSHERLTTYK DTAHTEAVHP STNTGGTNVA TTSSGYKSQS SVLADSSPMC

7801  TTSTMGDTSV LTSTPAFLET RRIQTELASS LTPGLRESSG SEGTSSGTKM

7851  STVLSKVPTG ATTEISKEDV TSIPGPAQST ISPDTSTRTV SWFSTSPVMT

7901  ESAEITMNTH TSPLGATTQG TSTLDTSSTT SLTMTHSTIS QGFSHSQMST

7951  LMRRGPEDVS WMSPPLLEKT RPSFSLMSSP ATTSPSPVSS TLPESISSSP

8001  LPVTSLLTSG LAKTTDMLHK SSEPVTNSPA NLSSTSVEIL ATSEVTTDTE

8051  KTHPSSNRTV TDVGTSSSGH ESTSFVLADS QTSKVTSPMV ITSTMEDTSV

8101  STSTPGFFET SRIQTEPTSS LTLGLRKTSS SEGTSLATEM STVLSGVPTG

8151  ATAEVSRTEV TSSSRTSISG FAQLTVSPET STETITRLPT SSIMTESAEM

8201  MIKTQTDPPG STPESTHTVD ISTTPNWVET HSTVTQRFSH SEMTTLVSRS

8251  PGDMLWPSQS SVEETSSASS LLSLPATTSP SPVSSTLVED FPSASLPVTS

8301  LLTPGLVITT DRMGISREPG TSSTSNLSST SHERLTTLED TVDTEAMQPS
```

TABLE 31-continued

Human Protein of CA125 Molecule
(SEQ ID NO: 315)

```
 8351  THTAVTNVRT SISGHESQSS VLSDSETPKA TSSMGTTYTM GETSVSISTS

8401  DFFETSRVQI EPTSSLTSGL RETSSSERIS SATEGSTVLS EVPSGATTEV

8451  SRTEVISSRG TSMSGPDQFT ISPDISTEAI TRLSTSPIMT ESAESAITIE

8501  TGSPGATSEG TLTLDTSTTT FWSGTHSTAS PGFSHSEMTT LMSRTPGDVP

8551  WPSLPSVEEA SSVSSSLSSP AMTSTSFFSA LPESISSSPH PVTALLTLGP

8601  VKTTDMLRTS SEPETSSPPN LSSTSAEILA TSEVTKDREK IHPSSNTPVV

8651  NVGTVIYKHL SPSSVLADLV TTKPTSPMAT TSTLGNTSVS TSTPAFPETM

8701  MTQPTSSLTS GLREISTSQE TSSATERSAS LSGMPTGATT KVSRTEALSL

8751  GRTSTPGPAQ STISPEISTE TITRISTPLT TTGSAEMTIT PKTGHSGASS

8801  QGTFTLDTSS RASWPGTHSA ATHRSPHSGM TTPMSRGPED VSWPSRPSVE

8851  KTSPPSSLVS LSAVTSPSPL YSTPSESSHS SPLRVTSLFT PVMMKTTDML

8901  DTSLEPVTTS PPSMNITSDE SLATSKATME TEAIQLSENT AVTQMGTISA

8951  RQEFYSSYPG LPEPSKVTSP VVTSSTIKDI VSTTIPASSE ITRIEMESTS

9001  TLTPTPRETS TSQEIHSATK PSTVPYKALT SATIEDSMTQ VMSSSRGPSP

9051  DQSTMSQDIS TEVITRLSTS PIKAESTEMT ITTQTGSPGA TSRGTLTLDT

9101  STTFMSGTHS TASQGFSHSQ MTALMSRTPG DVPWLSHPSV EEASSASFSL

9151  SSPVMTSSSP VSSTLPDSIH SSSLPVTSLL TSGLVKTTEL LGTSSEPETS

9201  SPPNLSSTSA EILATTEVTT DTEKLEMTNV VTSGYTHESP SSVLADSVTT

9251  KATSSMGITY PTGDTNVLTS TPAFSDTSRI QTKSKLSLTP GLMETSISEE

9301  TSSATEKSTV LSSVPTGATT EVSRTEAISS SRTSIPGPAQ STMSSDTSME

9351  TITRISTPLT RKESTDMAIT PKTGPSGATS QGTFTLDSSS TASWPGTHSA

9401  TTQRFPQSVV TTPMSRGPED VSWPSPLSVE KNSPPSSLVS SSSVTSPSPL

9451  YSTPSGSSHS SPVPVTSLFT SIMMKATDML DASLEPETTS APNMNITSDE

9501  SLATSKATTE TEAIHVFENT AASHVETTSA TEELYSSSPG FSEPTKVISP

9551  VVTSSSIRDN MVSTTMPGSS GITRIEIESM SSLTPGLRET RTSQDITSST

9601  ETSTVLYKMS SGATPEVSRT EVMPSSRTSI PGPAQSTMSL DISDEVVTRL

9651  STSPIMTESA EITITTQTGY SLATSQVTLP LGTSMTFLSG THSTMSQGLS

9701  HSEMTNLMSR GPESLSWTSP RFVETTRSSS SLTSLPLTTS LSPVSSTLLD

9751  SSPSSPLPVT SLILPGLVKT TEVLDTSSEP KTSSSPNLSS TSVEIPATSE

9801  IMTDTEKIHP SSNTAVAKVR TSSSVHESHS SVLADSETTI TIPSMGITSA

9851  VDDTTVFTSN PAFSETRRIP TEPTFSLTPG FRETSTSEET TSITETSAVL

9901  YGVPTSATTE VSMTEIMSSN RTHIPDSDQS TMSPDIITEV ITRLSSSSMM

9951  SESTQMTITT QKSSPGATAQ STLTLATTTA PLARTHSTVP PRFLHSEMTT

10001  LMSRSPENPS WKSSPFVEKT SSSSSLLSLP VTTSPSVSST LPQSIPSSSF

10051  SVTSLLTPGM VKTTDTSTEP GTSLSPNLSG TSVEILAASE VTTDTEKIHP

10101  SSSMAVTNVG TTSSGHELYS SVSIHSEPSK ATYPVGTPSS MAETSISTSM

10151  PANFETTGFE AEPFSHLTSG FRKTNMSLDT SSVTPTNTPS SPGSTHLLQS

10201  SKTDFTSSAK TSSPDWPPAS QYTEIPVDII TPFNASPSIT ESTGITSFPE
```

TABLE 31-continued

Human Protein of CA125 Molecule
(SEQ ID NO: 315)

```
10251  SRFTMSVTES THHLSTDLLP SAETISTGTV MPSLSEAMTS FATTGVPRAI

10301  SGSGSPFSRT ESGPGDATLS TIAESLPSST PVPFSSSTFT TTDSSTIPAL

10351  HEITSSSATP YRVDTSLGTE SSTTEGRLVM VSTLDTSSQP GRTSSTPILD

10401  TRMTESVELG TVTSAYQVPS LSTRLTRTDG IMEHITKIPN EAAHRGTIRP

10451  VKGPQTSTSP ASPKGLHTGG TKRMETTTTA LKTTTTALKT TSRATLTTSV

10501  YTPTLGTLTP LNASRQMAST ILTEMMITTP YVFPDVPETT SSLATSLGAE

10551  TSTALPRTTP SVLNRESETT ASLVSRSGAE RSPVIQTLDV SSSEPDTTAS

10601  WVIHPAETIP TVSKTTPNFF HSELDTVSST ATSHGADVSS AIPTNISPSE

10651  LDALTPLVTI SGTDTSTTFP TLTKSPHETE TRTTWLTHPA ETSSTIPRTI

10701  PNFSHHESDA TPSIATSPGA ETSSAIPIMT VSPGAEDLVT SQVTSSGTDR

10751  NMTIPTLTLS PGEPKTIASL VTHPEAQTSS AIPTSTISPA VSRLVTSMVT

10801  SLAAKTSTTN RALTNSPGEP ATTVSLVTHP AQTSPTVPWT TSIFFHSKSD

10851  TTPSMTTSHG AESSSAVPTP TVSTEVPGVV TPLVTSSRAV ISTTIPILTL

10901  SPGEPETTPS MATSHGEEAS SAIPTPTVSP GVPGVVTSLV TSSRAVTSTT

10951  IPILTFSLGE PETTPSMATS HGTEAGSAVP TVLPEVPGMV TSLVASSRAV

11001  TSTTLPTLTL SPGEPETTPS MATSHGAEAS STVPTVSPEV PGVVTSLVTS

11051  SSGVNSTSIP TLILSPGELE TTPSMATSHG AEASSAVPTP TVSPGVSGVV

11101  TPLVTSSRAV TSTTIPILTL SSSEPETTPS MATSHGVEAS SAVLTVSPEV

11151  PGMVTSLVTS SRAVTSTTIP TLTISSDEPE TTTSLVTHSE AKMISAIPTL

11201  AVSPTVQGLV TSLVTSSGSE TSAFSNLTVA SSQPETIDSW VAHPGTEASS

11251  VVPTLTVSTG EPFTNISLVT HPAESSSTLP RTTSRFSHSE LDTMPSTVTS

11301  PEAESSSAIS TTISPGIPGV LTSLVTSSGR DISATFPTVP ESPHESEATA

11351  SWVTHPAVTS TTVPRTTPNY SHSEPDTTPS IATSPGAEAT SDFPTITVSP

11401  DVPDMVTSQV TSSGTDTSIT IPTLTLSSGE PETTTSFITY SETHTSSAIP

11451  TLPVSPGASK MLTSLVISSG TDSTTTFPTL TETPYEPETT AIQLIHPAET

11501  NTMVPRTTPK FSHSKSDTTL PVAITSPGPE ASSAVSTTTI SPDMSDLVTS

11551  LVPSSGTDTS TTFPTLSETP YEPETTATWL THPAETSTTV SGTIPNFSHR

11601  GSDTAPSMVT SPGVDTRSGV PTTTIPPSIP GVVTSQVTSS ATDTSTAIPT

11651  LTPSPGEPET TASSATHPGT QTGFTVPIRT VPSSEPDTMA SWVTHPPQTS

11701  TPVSRTTSSF SHSSPDATPV MATSPRTEAS SAVLTTISPG APEMVTSQIT

11751  SSGAATSTTV PTLTHSPGMP ETTALLSTHP RTETSKTFPA STVFPQVSET

11801  TASLTIRPGA ETSTALPTQT TSSLFTLLVT GTSRVDLSPT ASPGVSAKTA

11851  PLSTHPGTET STMIPTSTLS LGLLETTGLL ATSSSAETST STLTLTVSPA

11901  VSGLSSASIT TDKPQTVTSW NTETSPSVTS VGPPEFSRTV TGTTMTLIPS

11951  EMPTPPKTSH GEGVSPTTIL RTTMVEATNL ATTGSSPTVA KTTTTFNTLA

12001  GSLFTPLTTP GMSTLASESV TSRTSYNHRS WISTTSSYNR RYWTPATSTP

12051  VTSTFSPGIS TSSIPSSTAA TVPFMVPFTL NFTITNLQYE EDMRHPGSRK

12101  FNATERELQG LLKPLFRNSS LEYLYSGCRL ASLRPEKDSS AMAVDAICTH

12151  RPDPEDLGLD RERLYWELSN LTNGIQELGP YTLDRNSLYV NGFTHRSSMP
```

TABLE 31-continued

Human Protein of CA125 Molecule
(SEQ ID NO: 315)

```
12201  TTSTPGTSTV DVGTSGTPSS SPSPTAAGPL LMPFTLNFTI TNLQYEEDMR

12251  RTGSRKFNTM ESVLQGLLKP LFKNTSVGPL YSGCRLTLLR PEKDGAATGV

12301  DAICTHRLDP KSPGLNREQL YWELSKLTND IEELGPYTLD RNSLYVNGFT

12351  HQSSVSTTST PGTSTVDLRT SGTPSSLSSP TIMAAGPLLV PFTLNFTITN

12401  LQYGEDMGHP GSRKFNTTER VLQGLLGPIF KNTSVGPLYS GCRLTSLRSE

12451  KDGAATGVDA ICIHHLDPKS PGLNRERLYW ELSQLTNGIK ELGPYTLDRN

12501  SLYVNGFTHR TSVPTSSTPG TSTVDLGTSG TPFSLPSPAT AGPLLVLFTL

12551  NFTITNLKYE EDMHRPGSRK FNTTERVLQT LLGPMFKNTS VGLLYSGCRL

12601  TLLRSEKDGA ATGVDAICTH RLDPKSPGLD REQLYWELSQ LTNGIKELGP

12651  YTLDRNSLYV NGFTHWIPVP TSSTPGTSTV DLGSGTPSSL PSPTAAGPLL

12701  VPFTLNFTIT NLQYEEDMHH PGSRKFNTTE RVLQGLLGPM FKNTSVGLLY

12751  SGCRLTLLRS EKDGAATGVD AICTHRLDPK SPGVDREQLY WELSQLTNGI

12801  KELGPYTLDR NSLYVNGFTH QTSAPNTSTP GTSTVDLGTS GTPSSLPSPT

12851  SAGPLLVPFT LNFTITNLQY EEDMRHPGSR KFNTTERVLQ GLLKPLFKST

12901  SVGPLYSGCR LTLLRSEKDG AATGVDAICT HRLDPKSPGV DREQLYWELS

12951  QLTNGIKELG PYTLDRNSLY VNGFTHQTSA PNTSTPGTST VDLGTSGTPS

13001  SLPSPTSAGP LLVPFTLNFT ITNLQYEEDM HHPGSRKFNT TERVLQGLLG

13051  PMFKNTSVGL LYSGCRLTLL RPEKNGAATG MDAICSHRLD PKSPGLNREQ

13101  LYWELSQLTH GIKELGPYTL DRNSLYVNGF THRSSVAPTS TPGTSTVDLG

13151  TSGTPSSLPS PTTAVPLLVP FTLNFTITNL QYGEDMRHPG SRKFNTTERV

13201  LQGLLGPLFK NSSVGPLYSG CRLISLRSEK DGAATGVDAI CTHHLNPQSP

13251  GLDREQLYWQ LSQMTNGIKE LGPYTLDRNS LYVNGFTHRS SGLTTSTPWT

13301  STVDLGTSGT PSPVPSPTTA GPLLVPFTLN FTITNLQYEE DMHRPGSRKF

13351  NATERVLQGL LSPIFKNSSV GPLYSGCRLT SLRPEKDGAA TGMDAVCLYH

13401  PNPKRPGLDR EQLYWELSQL THNITELGPY SLDRDSLYVN GFTHQNSVPT

13451  TSTPGTSTVY WATTGTPSSF PGHTEPGPLL IPFTFNFTIT NLHYEENMQH

13501  PGSRKFNTTE RVLQGLLKPL FKNTSVGPLY SGCRLTSLRP EKDGAATGMD

13551  AVCLYHPNPK RPGLDREQLY CELSQLTHNI TELGPYSLDR DSLYVNGFTH

13601  QNSVPTTSTP GTSTVYWATT GTPSSFPGHT EPGPLLIPFT FNFTITNLHY

13651  EENMQHPGSR KFNTTERVLQ GLLKPLFKNT SVGPLYSGCR LTLLRPEKHE

13701  AATGVDTICT HRVDPIGPGL DRERLYWELS QLTNSITELG PYTLDRDSLY

13751  VNGFNPRSSV PTTSTPGTST VHLATSGTPS SLPGHTAPVP LLIPFTLNFT

13801  ITNLHYEENM QHPGSRKFNT TERVLQGLLK PLFKNTSVGP LYSGCRLTLL

13851  RPEKHEAATG VDTICTHRVD PIGPGLDREX LYWELSXLTX XIXELGPYXL

13901  DRXSLYVNGF XXXXXXXXTS TPGTSXVXLX TSGTPXXXPX XTSAGPLLVP

13951  FTLNFTITNL QYEEDMHHPG SRKFNTTERV LQGLLGPMFK NTSVGLLYSG

14001  CRLTLLRPEK NGAATGMDAI CSHRLDPKSP GLDREQLYWE LSQLTHGIKE

14051  LGPYTLDRNS LYVNGFTHRS SVAPTSTPGT STVDLGTSGT PSSLPSPTTA
```

TABLE 31-continued

Human Protein of CA125 Molecule
(SEQ ID NO: 315)

```
14101  VPLLVPFTLN FTITNLQYGE DMRHPGSRKF NTTERVLQGL LGPLFKNSSV

14151  GPLYSGCRLI SLRSEKDGAA TGVDAICTHH LNPQSPGLDR EQLYWQLSQM

14201  TNGIKELGPY TLDRNSLYVN GFTHRSSGLT TSTPWTSTVD LGTSGTPSPV

14251  PSPTTAGPLL VPFTLNFTIT NLQYEEDMHR PGSRKFNATE RVLQGLLSPI

14301  FKNSSVGPLY SGCRLTSLRP EKDGAATGMD AVCLYHPNPK RPGLDREQLY

14351  WELSQLTHNI TELGPYSLDR DSLYVNGFTH QSSMTTTRTP DTSTMHLATS

14401  RTPASLSGPT TASPLLVLFT INCTITNLQY EEDMRRTGSR KFNTMESVLQ

14451  GLLKPLFKNT SVGPLYSGCR LTLLRPKKDG AATGVDAICT HRLDPKSPGL

14501  NREQLYWELS KLTNDIEELG PYTLDRNSLY VNGFTHQSSV STTSTPGTST

14551  VDLRTSGTPS SLSSPTIMXX XPLLXPFTLN FTITNLXYEE XMXXPGSRKF

14601  NTTERVLQGL LRPLFKNTSV SSLYSGCRLT LLRPEKDGAA TRVDAACTYR

14651  PDPKSPGLDR EQLYWELSQL THSITELGPY TLDRVSLYVN GFNPRSSVPT

14701  TSTPGTSTVH LATSGTPSSL PGHTXXXPLL XPFTLNFTIT NLXYEEXMXX

14751  PGSRKFNTTE RVLQGLLKPL FRNSSLEYLY SGCRLASLRP EKDSSAMAVD

14801  AICTHRPDPE DLGLDRERLY WELSNLTNGI QELGPYTLDR NSLYVNGFTH

14851  RSSFLTTSTP WTSTVDLGTS GTPSPVPSPT TAGPLLVPFT LNFTITNLQY

14901  EEDMHRPGSR RFNTTERVLQ GLLTPLFKNT SVGPLYSGCR LTLLRPEKQE

14951  AATGVDTICT HRVDPIGPGL DRERLYWELS QLTNSITELG PYTLDRDSLY

15001  VNGFNPWSSV PTTSTPGTST VHLATSGTPS SLPGHTAPVP LLIPFTLNFT

15051  ITDLHYEENM QHPGSRKFNT TERVLQGLLK PLFKSTSVGP LYSGCRLTLL

15101  RPEKHGAATG VDAICTLRLD PTGPGLDRER LYWELSQLTN SVTELGPYTL

15151  DRDSLYVNGF THRSSVPTTS IPGTSAVHLE TSGTPASLPG HTAPGPLLVP

15201  FTLNFTITNL QYEEDMRHPG SRKFSTTERV LQGLLKPLFK NTSVSSLYSG

15251  CRLTLLRPEK DGAATRVDAV CTHRPDPKSP GLDRERLYWK LSQLTHGITE

15301  LGPYTLDRHS LYVNGFTHQS SMTTTRTPDT STMHLATSRT PASLSGPTTA

15351  SPLLVLFTIN FTITNQRYEE NMHHPGSRKF NTTERVLQGL LRPVFKNTSV

15401  GPLYSGCRLT LLRPKKDGAA TKVDAICTYR PDPKSPGLDR EQLYWELSQL

15451  THSITELGPY TQDRDSLYVN GFTHRSSVPT TSIPGTSAVH LETSGTPASL

15501  PGHTAPGPLL VPFTLNFTIT NLQYEEDMRH PGSRKFNTTE RVLQGLLKPL

15551  FKSTSVGPLY SGCRLTLLRP EKRGAATGVD TICTHRLDPL NPGLDREQLY

15601  WELSKLTRGI IELGPYLLDR GSLYVNGFTH RTSVPTTSTP GTSTVDLGTS

15651  GTPFSLPSPA XXXPLLXPFT LNFTITNLXY EEXMXXPGSR KFNTTERVLQ

15701  TLLGPMFKNT SVGLLYSGCR LTLLRSEKDG AATGVDAICT HRLDPKSPGV

15751  DREQLYWELS QLTNGIKELG PYTLDRNSLY VNGFTHWIPV PTSSTPGTST

15801  VDLGSGTPSL PSSPTTAGPL LVPFTLNFTI TNLKYEEDMH CPGSRKFNTT

15851  ERVLQSLLGP MFKNTSVGPL YSGCRLTLLR SEKDGAATGV DAICTHRLDP

15901  KSPGVDREQL YWELSQLTNG IKELGPYTLD RNSLYVNGFT HQTSAPNTST

15951  PGTSTVDLGT SGTPSSLPSP TXXXPLLXPF TLNFTITNLX YEEXMXXPGS

16001  RKFNTTERVL QGLLXPXFKX TSVGXLYSGC RLTLLRXEKX XAATXVDXXC
```

TABLE 31-continued

Human Protein of CA125 Molecule
(SEQ ID NO: 315)

```
16051  XXXXDPXXPG LDREXLYWEL SXLTXXIXEL GPYXLDRXSL YVNGFTHWIP

16101  VPTSSTPGTS TVDLGSGTPS SLPSPTTAGP LLVPFTLNFT ITNLKYEEDM

16151  HCPGSRKFNT TERVLQSLLG PMFKNTSVGP LYSGCRLTSL RSEKDGAATG

16201  VDAICTHRVD PKSPGVDREQ LYWELSQLTN GIKELGPYTL DRNSLYVNGF

16251  THQTSAPNTS TPGTSTVDLG TSGTPSSLPS PTSAGPLLVP FTLNFTITNL

16301  QYEEDMHHPG SRKFNTTERV LQGLLGPMFK NTSVGLLYSG CRLTLLRPEK

16351  NGAATGMDAI CTHRLDPKSP GLDREXLYWE LSXLTXXIXE LGPYXLDRXS

16401  LYVNGFXXXX XXXXTSTPGT SXVXLXTSGT PXXXPXXTXX XPLLXPFTLN

16451  FTITNLXYEE XMXXPGSRKF NTTERVLQGL LKPLFRNSSL EYLYSGCRLA

16501  SLRPEKDSSA MAVDAICTHR PDPEDLGLDR ERLYWELSNL TNGIQELGPY

16551  TLDRNSLYVN GFTHRSSMPT TSTPGTSTVD VGTSGTPSSS PSPTTAGPLL

16601  IPFTLNFTIT NLQYGEDMGH PGSRKFNTTE RVLQGLLGPI FKNTSVGPLY

16651  SGCRLTSLRS EKDGAATGVD AICIHHLDPK SPGLNRERLY WELSQLTNGI

16701  KELGPYTLDR NSLYVNGFTH RTSVPTTSTP GTSTVDLGTS GTPFSLPSPA

16751  TAGPLLVLFT LNFTITNLKY EEDMHRPGSR KFNTTERVLQ TLLGPMFKNT

16801  SVGLLYSGCR LTLLRSEKDG AATGVDAICT HRLDPKSPGL DREXLYWELS

16851  XLTXXIXELG PYXLDRXSLY VNGFXXXXXX XXTSTPGTSX VXLXTSGTPX

16901  XXPXXTXXXP LLXPFTLNFT ITNLXYEEXM XXPGSRKFNT TERVLQGLLR

16951  PVFKNTSVGP LYSGCRLTLL RPKKDGAATK VDAICTYRPD PKSPGLDREQ

17001  LYWELSQLTH SITELGPYTQ DRDSLYVNGF THRSSVPTTS IPGTSAVHLE

17051  TTGTPSSFPG HTEPGPLLIP FTFNFTITNL RYEENMQHPG SRKFNTTERV

17101  LQGLLTPLFK NTSVGPLYSG CRLTLLRPEK QEAATGVDTI CTHRVDPIGP

17151  GLDRERLYWE LSQLTNSITE LGPYTLDRDS LYVDGFNPWS SVPTTSTPGT

17201  STVHLATSGT PSPLPGHTAP VPLLIPFTLN FTITDLHYEE NMQHPGSRKF

17251  NTTERVLQGL LKPLFKSTSV GPLYSGCRLT LLRPEKHGAA TGVDAICTLR

17301  LDPTGPGLDR ERLYWELSQL TNSITELGPY TLDRDSLYVN GFNPWSSVPT

17351  TSTPGTSTVH LATSGTPSSL PGHTTAGPLL VPFTLNFTIT NLKYEEDMHC

17401  PGSRKFNTTE RVLQSLHGPM FKNTSVGPLY SGCRLTLLRS EKDGAATGVD

17451  AICTHRLDPK SPGLDREXLY WELSXLTXXI XELGPYXLDR XSLYVNGFXX

17501  XXXXXXTSTP GTSXVXLXTS GTPXXXPXXT XXXPLLXPFT LNFTITNLXY

17551  EEXMXXPGSR KFNTTERVLQ GLLXPXFKXT SVGXLYSGCR LTLLRXEKXX

17601  AATXVDXXCX XXXDPXXPGL DREXLYWELS XLTNSITELG PYTLDRDSLY

17651  VNGFTHRSSM PTTSIPGTSA VHLETSGTPA SLPGHTAPGP LLVPFTLNFT

17701  ITNLQYEEDM RHPGSRKFNT TERVLQGLLK PLFKSTSVGP LYSGCRLTLL

17751  RPEKRGAATG VDTICTHRLD PLNPGLDREX LYWELSXLTX XIXELGPYXL

17801  DRXSLYVNGF XXXXXXXXTS TPGTSXVXLX TSGTPXXXPX XTXXXPLLXP

17851  FTLNFTITNL XYEEXMXXPG SRKFNTTERV LQGLLXPXFK TSVGXLYSG

17901  CRLTLLRXEK XXAATXVDXX CXXXXDPXXP GLDREXLYWE LSXLTXXIXE
```

TABLE 31-continued

Human Protein of CA125 Molecule
(SEQ ID NO: 315)

```
17951  LGPYXLDRXS LYVNGFHPRS SVPTTSTPGT STVHLATSGT PSSLPGHTAP

18001  VPLLIPFTLN FTITNLHYEE NMQHPGSRKF NTTERVLQGL LGPMFKNTSV

18051  GLLYSGCRLT LLRPEKNGAA TGMDAICSHR LDPKSPGLDR EXLYWELSXL

18101  TXXIXELGPY XLDRXSLYVN GFXXXXXXXX TSTPGTSXVX LXTSGTPXXX

18151  PXXTXXXPLL XPFTLNFTIT NLXYEEXMXX PGSRKFNTTE RVLQGLLXPX

18201  FKXTSVGXLY SGCRLTLLRX EKXXAATXVD XXCXXXXDPX XPGLDREXLY

18251  WELSXLTXXI XELGPYXLDR XSLYVNGFTH QNSVPTTSTP GTSTVYWATT

18301  GTPSSFPGHT EPGPLLIPFT FNFTITNLHY EENMQHPGSR KFNTTERVLQ

18351  GLLTPLFKNT SVGPLYSGCR LTLLRPEKQE AATGVDTICT HRVDPIGPGL

18401  DREXLYWELS XLTXXIXELG PYXLDRXSLY VNGFXXXXXX XXTSTPGTSX

18451  VXLXTSGTPX XXPXXTXXXP LLXPFTLNFT ITNLXYEEXM XXPGSRKFNT

18501  TERVLQGLLX PXFKXTSVGX LYSGCRLTLL RXEKXXAATX VDXXCXXXXD

18551  PXXPGLDREX LYWELSXLTX XIXELGPYXL DRXSLYVNGF THRSSVPTTS

18601  SPGTSTVHLA TSGTPSSLPG HTAPVPLLIP FTLNFTITNL HYEENMQHPG

18651  SRKFNTTERV LQGLLKPLFK STSVGPLYSG CRLTLLRPEK HGAATGVDAI

18701  CTLRLDPTGP GLDREXLYWE LSXLTXXIXE LGPYXLDRXS LYVNGFXXXX

18751  XXXXTSTPGT SXVXLXTSGT PXXXPXXTXX XPLLXPFTLN FTITNLXYEE

18801  XMXXPGSRKF NTTERVLQGL LXPXFKXTSV GXLYSGCRLT LLRXEKXXAA

18851  TXVDXXCXXX XDPXXPGLDR EXLYWELSXL TXXIXELGPY XLDRXSLYVN

18901  GFTHRTSVPT TSTPGTSTVH LATSGTPSSL PGHTAPVPLL IPFTLNFTIT

18951  NLQYEEDMHR PGSRKFNTTE RVLQGLLSPI FKNSSVGPLY SGCRLTSLRP

19001  EKDGAATGMD AVCLYHPNPK RPGLDREQLY CELSQLTHNI TELGPYSLDR

19051  DSLYVNGFTH QNSVPTTSTP GTSTVYWATT GTPSSFPGHT XXXPLLXPFT

19101  LNFTITNLXY EEXMXXPGSR KFNTTERVLQ GLLXPXFKXT SVGXLYSGCR

19151  LTLLRXEKXX AATXVDXXCX XXXDPXXPGL DREXLYWELS XLTXXIXELG

19201  PYXLDRXSLY VNGFTHWSSG LTTSTPWTST VDLGTSGTPS PVPSPTTAGP

19251  LLVPFTLNFT ITNLQYEEDM HRPGSRKFNA TERVLQGLLS PIFKNTSVGP

19301  LYSGCRLTLL RPEKQEAATG VDTICTHRVD PIGPGLDREX LYWELSXLTX

19351  XIXELGPYXL DRXSLYVNGF XXXXXXXXTS TPGTSXVXLX TSGTPXXXPX

19401  XTXXXPLLXP FTLNFTITNL XYEEXMXXPG SRKFNTTERV LQGLLXPXFK

19451  XTSVGXLYSG CRLTLLRXEK XXAATXVDXX CXXXXDPXXP GLDREXLYWE

19501  LSXLTXXIXE LGPYXLDRXS LYVNGFTHRS FGLTTSTPWT STVDLGTSGT

19551  PSPVPSPTTA GPLLVPFTLN FTITNLQYEE DMHRPGSRKF NTTERVLQGL

19601  LTPLFRNTSV SSLYSGCRLT LLRPEKDGAA TRVDAVCTHR PDPKSPGLDR

19651  EXLYWELSXL TXXIXELGPY XLDRXSLYVN GFXXXXXXXX TSTPGTSXVX

19701  LXTSGTPXXX PXXTXXXPLL XPFTLNFTIT NLXYEEXMXX PGSRKFNTTE

19751  RVLQGLLXPX FKXTSVGXLY SGCRLTLLRX EKXXAATXVD XXCXXXXDPX

19801  XPGLDREXLY WELSXLTXXI XELGPYXLDR XSLYVNGFTH WIPVPTSSTP

19851  GTSTVDLGSG TPSSLPSPTT AGPLLVPFTL NFTITNLQYG EDMGHPGSRK
```

TABLE 31-continued

Human Protein of CA125 Molecule
(SEQ ID NO: 315)

```
19901  FNTTERVLQG LLGPIFKNTS VGPLYSGCRL TSLRSEKDGA ATGVDAICIH
19951  HLDPKSPGLD REXLYWELSX LTXXIXELGP YXLDRXSLYV NGFXXXXXXX
20001  XTSTPGTSXV XLXTSGTPXX XPXXTXXXPL LXPFTLNFTI TNLXYEEXMX
20051  XPGSRKFNTT ERVLQGLLXP XFKXTSVGXL YSGCRLTLLR XEKXXAATXV
20101  DXXCXXXXDP XXPGLDREXL YWELSXLTXX IXELGPYXLD RXSLYVNGFT
20151  HQTFAPNTST PGTSTVDLGT SGTPSSLPSP TSAGPLLVPF TLNFTITNLQ
20201  YEEDMHHPGS RKFNTTERVL QGLLGPMFKN TSVGLLYSGC RLTLLRPEKN
20251  GAATRVDAVC THRPDPKSPG LDREXLYWEL SXLTXXIXEL GPYXLDRXSL
20301  YVNGFXXXXX XXXTSTPGTS XVXLXTSGTP XXXPXXTAPV PLLIPFTLNF
20351  TITNLHYEEN MQHPGSRKFN TTERVLQGLL RPLFKSTSVG PLYSGCRLTL
20401  LRPEKHGAAT GVDAICTLRL DPTGPGLDRE RLYWELSQLT NSVTELGPYT
20451  LDRDSLYVNG FTQRSSVPTT SIPGTSAVHL ETSGTPASLP GHTAPGPLLV
20501  PFTLNFTITN LQYEVDMRHP GSRKFNTTER VLQGLLKPLF KSTSVGPLYS
20551  GCRLTLLRPE KRGAATGVDT ICTHRLDPLN PGLDREQLYW ELSKLTRGII
20601  ELGPYLLDRG SLYVNGFTHR NFVPITSTPG TSTVHLGTSE TPSSLPRPIV
20651  PGPLLVPFTL NFTITNLQYE EAMRHPGSRK FNTTERVLQG LLRPLFKNTS
20701  IGPLYSSCRL TLLRPEKDKA ATRVDAICTH HPDPQSPGLN REQLYWELSQ
20751  LTHGITELGP YTLDRDSLYV DGFTHWSPIP TTSTPGTSIV NLGTSGIPPS
20801  LPETTXXXPL LXPFTLNFTI TNLXYEEXMX XPGSRKFNTT ERVLQGLLKP
20851  LFKSTSVGPL YSGCRLTLLR PEKDGVATRV DAICTHRPDP KIPGLDRQQL
20901  YWELSQLTHS ITELGPYTLD RDSLYVNGFT QRSSVPTTST PGTFTVQPET
20951  SETPSSLPGP TATGPVLLPF TLNFTITNLQ YEEDMHRPGS RKFNTTERVL
21001  QGLLMPLFKN TSVSSLYSGC RLTLLRPEKD GAATRVDAVC THRPDPKSPG
21051  LDRERLYWKL SQLTHGITEL GPYTLDRHSL YVNGFTHQSS MTTTRTPDTS
21101  TMHLATSRTP ASLSGPTTAS PLLVLFTINF TITNLRYEEN MHHPGSRKFN
21151  TTERVLQGLL RPVFKNTSVG PLYSGCRLTL LRPKKDGAAT KVDAICTYRP
21201  DPKSPGLDRE QLYWELSQLT HSITELGPYT QDRDSLYNVG FTQRSSVPTT
21251  SVPGTPTVDL GTSGTPVSKP GPSAASPLLV LFTLNGTITN LRYEENMQHP
21301  GSRKFNTTER VLQGLLRSLF KSTSVGPLYS GCRLTLLRPE KDGTATGVDA
21351  ICTHHPDPKS PRLDREQLYW ELSQLTHNIT ELGHYALDND SLFVNGFTHR
21401  SSVSTTSTPG TPTVYLGASK TPASIFGPSA ASHLLILFTL NFTITNLRYE
21451  ENMWPGSRKF NTTERVLQGL LRPLFKNTSV GPLYSGSRLT LLRPEKDGEA
21501  TGVDAICTHR PDPTGPGLDR EQLYLELSQL THSITELGPY TLDRDSLYVN
21551  GFTHRSSVPT TSTGVVSEEP FTLNFTINNL RYMADMGQPG SLKFNITDNV
21601  MKHLLSPLFQ RSSLGARYTG CRVIALRSVK NGAETRVDLL CTYLQPLSGP
21651  GLPIKQVFHE LSQQTHGITR LGPYSLDKDS LYLNGYNEPG LDEPPTTPKP
21701  ATTFLPPLSE ATTAMGYHLK TLTLNFTISN LQYSPDMGKG SATFNSTEGV
21751  LQHLLRPLFQ KSSMGPFYLG CQLISLRPEK DGAATGVDTT CTYHPDPVGP
```

TABLE 31-continued

Human Protein of CA125 Molecule
(SEQ ID NO: 315)

```
21801  GLDIQQLYWE  LSQLTHGVTQ  LGFYVLDRDS  LFINGYAPQN  LSIRGEYQIN

21851  FHIVNWNLSN  PDPTSSEYIT  LLRDIQDKVT  TLYKGSQLHD  TFRFCLVTNL

21901  TMDSVLVTVK  ALFSSNLDPS  LVEQVFLDKT  LNASFHWLGS  TYQLVDIHVT

21951  EMESSVYQPT  SSSSTQHFYL  NFTITNLPYS  QDKAQPGTTN  YQRNKRNIED

22001  ALNQLFRNSS  IKSYFSDCQV  STFRSVPNRH  HTGVDSLCNF  SPLARRVDRV

22051  AIYEEFLRMT  RNGTQLQNFT  LDRSSVLVDG  YSPNRNEPLT  GNSDLPFWAV

22101  ILIGLAGLLG  LITCLICGVL  VTTRRRKKEG  EYNVQQQCPG  YYQSHLDLED

22151  LQ
```

SEQUENCE LISTING (315 sequences)

SEQ ID NO: 1 - protein, 13 aa, Homo sapiens
QHPGSRKFKTTEG

SEQ ID NO: 2 - protein, 11 aa, Homo sapiens
FLTVERVLQGL

SEQ ID NO: 3 - protein, 8 aa, Homo sapiens
DTYVGPLY

SEQ ID NO: 4 - protein, 8 aa, Homo sapiens
DGAANGVD

SEQ ID NO: 5 - DNA, 240 bp, Homo sapiens
  CDS (1)..(240)
cgtcgacctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagggtgatgca

SEQ ID NO: 6 - protein, 80 aa, Homo sapiens
RRPGSRKFNTTERVLQGLLRPVFKNTSVGPLYSGCRLTLLRPKKDGAATKVDAICTYRPDPKSPGLDREQLYWELSQGDA

SEQ ID NO: 7 - DNA, 20 bp, Artificial Sequence
  Synthetic Primer
ggagagggttctgcagggtc

SEQ ID NO: 8 - protein, 6 aa, Artificial Sequence
  Synthetic Primer
ERVLQG

SEQ ID NO: 9 - DNA, 20 bp, Artificial Sequence
  Synthetic Primer
gtgaatggtatcaggagagg

SEQ ID NO: 10 - protein, 6 aa, Artificial Sequence
  Synthetic Primer
PLLIPF

SEQ ID NO: 11 - protein, 131 aa, Homo sapiens
ERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASPLLIPFT

SEQ ID NO: 12 - protein, 130 aa, Homo sapiens
ERVLQGLLMPLFKNTSVSSLYSGCRLTLLRPEKDGAATRADAVCTHRPDPKSPGLDRERLYWKLSQLTHGITELGPYTLDRHSLYVNGFTHQSSMTTTRTPDTSTMHLATSRTPASLSGPTTASPLLIPF

SEQ ID NO: 13 - protein, 132 aa, Homo sapiens
ERVLQGLLGPIFKNTSVGPLYSGCRLTSLRSEKDGAATGVDAICIHRLDPKSPGLNREQLYWELSKLTNDIEELGPYTLDRNSLYVNGFTHQSSVSTTSTPGTSTVDLRTSGTPSSLSSPTIMAAGPLLIPF

SEQ ID NO: 14 - protein, 130 aa, Homo sapiens
ERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLIPF

SEQ ID NO: 15 - protein, 130 aa, Homo sapiens
ERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPFLIPF

SEQ ID NO: 16 - protein, 130 aa, Homo sapiens
ERVLQGLLRPLFKSTSAGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLIPF

SEQ ID NO: 17 - protein, 130 aa, Homo sapiens
ERVLQGLLKPLFKSTSVGPLYSGCRLTLLRPEKRGAATGVDTICTHRLDPLNPGLDREQLYWELSKLTRGIIELGPYTLDRDSLYVNGFTHRSSVPTTSIPGTSAVHLETSGTPASLPGHIVPGPLLIPF

SEQ ID NO: 18 - protein, 131 aa, Homo sapiens
ERVLQGLLTPLFKNTSVGPLYSGCRLTLLRPEKQEAATGVDTICTHRVDPIGPGLDRERLYWELSQLTNSITELGPYTLDRDSLYVDGFNPWSSVPTTSTPGTSTVHLATSGTPSPLPGHTAPVPLLIPFT

SEQ ID NO: 19 - protein, 131 aa, Homo sapiens
ERVLQGLLKPLFKNTSVGPLYSGCRLTLLRPEKHEAATGVDTICTHRLDPLNPGLDREQLYWELSKLTRGIIELGPYLLDRGSLYVNGFTHRNFVPITSTPGTSTVHLGTSETPSSLPRPIVPGPLLVPFT

SEQ ID NO: 20 - protein, 130 aa, Homo sapiens
ERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPF

SEQ ID NO: 21 - protein, 131 aa, Homo sapiens
ERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTATGPLLIPFT

SEQ ID NO: 22 - protein, 282 aa, Homo sapiens
ERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPL

SEQ ID NO: 23 - protein, 286 aa, Homo sapiens
ERVLQGLLKPLFRNSSLEYLYSGCRLASLRPEKDSSAMAVDAICTHRPDPEDLGLDRERLYWELSNLTNGIQELGPYTLDRNSLYVNGFTHRSSGLTTSTPWTSTVDLGTSGTPSPVPSPTTAGPLLIPFTLNFTITNLQYEENMGHPGSRKFNIMERVLQGLLMPLFKNTSVSSLYSGCRLTLLRPEKDGAATRVDAVCTQRPDPKSPGLDRERLYWKLSQLTHGITELGPYTLDRHSLYVNGLTHQSSMTTTRTPDTSTMHLATSRTPASLSGPTTASPLLIPF

SEQ ID NO: 24 - protein, 250 aa, Homo sapiens
ERVLQGLLKPLFKSTSVGPLYSGCRLTLLRPEKRGAATGVDTICTHRLDPLNPGLDREQLYWELSKLTRGIIELGPYLLDRGSLYVNGFTHRTSVPTTSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIP

SEQ ID NO: 25 - protein, 286 aa, Homo sapiens
ERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLIPFTINFTITNLRYEENMHHPGSRKFNIMERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLIPF

SEQ ID NO: 26 - protein, 286 aa, Homo sapiens
ERVLQGLLKPLFKSTSVGPLYSGCRLTLLRPEKRGAATGVDTICTHRLDPLNPGLDREQLYWELSKLTRGIIELGPYLLDRGSLYVNGFSRQSSMTTTRTPDTSTMHLATSRTPASLSGPTTASPLLIPFTLNFTITNLQYEENMGHPGSRKFNIMERVLQGLLNPIFKNSSVGPLYSGCRLTSLKPEKDGAATGMDAVCLYHPNPKRPGLDREQLYWELSQLTHGIKELGPYTLDRNSLYVNGFTHRSSVAPTSTPGTSTVDLGTSGTPSSLPSPTTAVPLLIPF

SEQ ID NO: 27 - protein, 286 aa, Homo sapiens
ERVLQGLLKPLFKSTSVGPLYSGCRLTLLRPEKRGAATGVDTICTHRLDPLNPGLDREQLYWELSKLTRGIIELGPYLLDRDSLYVNGFTHRSSVPTTSIPGTSAVHLETFGTPASLHGHTAPGPVLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLIPF

SEQ ID NO: 28 - protein, 286 aa, Homo sapiens
ERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLIPF

SEQ ID NO: 29 - protein, 281 aa, Homo sapiens
ERVLQGLLTPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTHRLDPKSPGVDREQLYWELSQLTNGIKELGPYTLDRNSLYVNGFTHWIPVPTSSTPGTSTVDLGSGTPSSLPSPTTAGPL

SEQ ID NO: 30 - protein, 217 aa, Homo sapiens
ERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTATGPLLIPFTPNFTITNLQYEEDMRRTGSRKFNTMERVLQGLLSPIFKNSSVGPLYSGCRLTSLRPEKDGAATGMDAVCLYHPNPKRPGLDREQLY

SEQ ID NO: 31 - protein, 286 aa, Homo sapiens
ERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQSSMTTTRTPDTSTMHLATSRTPASLSGPTTASPLLIPF

SEQ ID NO: 32 - protein, 288 aa, Homo sapiens
ERVLQGLLGPMFKNTSVGLLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLIPFTINFTITNLRYEENMGHPGSRKFNIMERVLQGLLKPLFKNTSVGPLYSGCRLTLLRPKKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLIPF

SEQ ID NO: 33 - protein, 284 aa, Homo sapiens
ERVLQGLLKPLFKSTSVGPLYSGCRLTLLRPEKDGAATGMDAVCLYHPNPKRPGLDREQLYCELSQLTHDITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTLLRPEKHEAATGVDTICTHRVDPIGPGLDRERLYWELSQLTNSIHELGPYTLDRDSLYVNGFNPRSSVPTTSTPGTSTVHLATSGTPSSLPGHTAPVPLLI

SEQ ID NO: 34 - protein, 288 aa, Homo sapiens
ERVLQGLLSPISKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTVNFTITNLRYEENMHHPGSRKFNTTERVLQGLLRPVFKNTSVGPLYSGCRLTLLRPKKDGAATKVDAICTYRPDPKSPGLDREQLYWELSKLTNDIEELGPYTLDRNSLYVNGFTHQSSVSTTSTPGTSTVDLRTSGTPSSLSSPTIMAAGPLLIPF

SEQ ID NO: 35 - protein, 274 aa, Homo sapiens
ERVLQGLLSPIFKNSSVGSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNQRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETSGTPASLP

SEQ ID NO: 36 - protein, 386 aa, Homo sapiens
ERVLQGLLGPMFKNTSVGLLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSVSSLYSGCRLTLLRPEKDGAATRVDAACTYRPDPKSPGLDREQLYWELSQLTHSITELGPYTLDRVSLYVNGFNPRSSVPTTSTPGTSTVHLATSGTPSSLPGHTAPVPLLIPFTLNFTITNLQYEEDMRHPGSRKFNTMERVLQGLLRPLFKNTSIGPLYSSCRLTLLRPEKDKAATRVDAICTHHPDPQSPGLNREQLYWELSQLTHGITEL

SEQ ID NO: 37 - protein, 438 aa, Homo sapiens
ERVLHGLLTPLFKNTRVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITNLHYEENMQHPGSRKFNTTERVLQGLLKPLFKNTSVGPLYSGCRLTLFKPEKHEAATGVDAICTLRLDPTGPGLDRERLYWELSQLTNSVTELGPYTLDRDSLYVNGFTHRSSVPTTSIPGTSAVHLETSGTPASLPGHTAPGPLLIPFTLNFTITNLQYEEDMRRTGSRKFNTMERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSEIHPSLPRPIVPGPL

SEQ ID NO: 38 - protein, 420 aa, Homo sapiens
GPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTLNFTITNLQYEENMGHPGSRKFNITESVLQGLLTPLFKNSSVGPLYSGCRLISLRSEKDGAATGVDAICTHHLNPQSPGLDREQLYWQLSQMTNGIKELGPYTLDRDSLYVNGFTHRSLGLTTSTPWTSTVDLGTSGTPSPVPSPTTAGPLLIPFTLNFTITNLQYEENMGHPGSRKFNIMERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASP

SEQ ID NO: 39 - protein, 439 aa, Homo sapiens
ERVLQGPLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTLNFTITNLQYEENMGHPGSRKFNITERVLQGLLNPIFKNSSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTEPGPLLIPFTLNFTITNLQYEEDMRRTGSRKFNTMERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLL

SEQ ID NO: 40 - protein, 424 aa, Homo sapiens
TSVGPLYSGCRLTLLRSEKDGAATGVDAIYTHRLDPKSPGVDREQLYWELSQLTNGIKELGPYTLDRNSLYVNGFTHQTSAPNTSTPGTSTVDLGTSGTPSSLPSPTSAGPLLIPFTINFTITNLRYEENMHHPGSRKFNTMERVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTIINLQYEEDMHRPGSRKFNTTERVLQGLLKPLFKSTSVGPLYSGCRLTLLRPEKHGAATGVDAICTLRLDPTGPGLDRERLYWELSQLTNSITELGPYTLDRDSLYVNGFNPWSSVPTTSTPGTSTVHLATSGTPSSLPGHTAPVPL

SEQ ID NO: 41 - protein, 418 aa, Homo sapiens
TLLRPKKDGVATGVDAICTHRLDPKSPGLNREQLYWELSKLTNDIEELGPYTLDRNSLYVNGFTHQSSVSTTSTPGTSTVDLRTSGTPSSLSSPTIMAAGPLLIPFTINFTITNLRYEENMHHPGSRKFNTMERVLQGLLMPLFKNTSVSSLYSGCRLTLLRPEKDGAATRVDAVCTHRPDPKSPGLDRERLYWKLSQLTHGITELGPYTLDRNSLYVNGFTHRSSMPTTSTPGTSTVDVGTSGTPSSSPSPTTAGPLLMPFTLNFTITNLQYEEDMRRTGSRKFNTMERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLIPF

SEQ ID NO: 42 - protein, 443 aa, Homo sapiens
ERVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTIINLQYEEDMHRPGSRKFNTTERVLQGLLMPLFKNTSVGPLYSGCRLTLLRPEKQEAATGVDTICTHRLDPSEPGLDREQLYWELSQLTNSITELGPYTLDRDSLYVNGFTHSGVLCPPPSILGIFTVQPETFETPSSLPGPTATGPVLLPFTLNFTIINLQYEEDMHRPGSRKFNTTERVLQGLLMPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPF

SEQ ID NO: 43 - protein, 442 aa, Homo sapiens
ERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPKKDGAATGVDAICTHRLDPKSPGLNREQLYWELSKLTNDIEEVGPYTLDRNSLYVNGFTHRSFVAPTSTLGTSTVDLGTSGTPSSLPSPTTGVPLLIPFTLNFTITNLQYEENMGHPGSRKFNIMERVLQGLLMPLFKNTSVSSLYSGCRLTLLRPEKDGAATRVVAVCTHRPDPKSPGLDRERLYWKLSQLTHGITELGPYTLDRHSLYVNGFTHQSSMTTTRTPDTSTMHLATSRTPASLSGPTTASPLLIPF

SEQ ID NO: 44 - protein, 442 aa, Homo sapiens
ERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLIPFTLNFTITNLQYEENMGHPGSRKFNITERVLQGLLKPLFRNSSLEYLYSGCRLTSLRPEKDSSTMAVDAICTHRPDPEDLGLDRERLYWELSNLTNGIQELGPYTLDRNSLYVNGFTHRSFMPTTSTLGTSTVDVGTSGTPSSSPSPTTAGPLLMPFTLNFTITNLQYEEDMRRTGSRKFNTMESVLQGLLKPLFKNTSVGPLYSGCRLTLLRPKKDGAATGVDAICTHRLDPKSPGLNREQLYWELSKLTNDIEELGPYTLDRNSLYVNGFTHQSSVSTTSTPGTSTVDPRTSGTPSSLSSPTIMAAGPLLI

SEQ ID NO: 45 - protein, 379 aa, Homo sapiens
ERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLIPFTLNFTITNLKYEEDMHCPGSRKFNTTERVLQSLFGPMFKNTSVGPLYSGCRLTLFRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMRRTGSRKFNTMESVLQGLLKPLFKNTSVGPLYSGCRLTLLRPEKDGAATGVDAICTHRLDPKSPGLNREQLYWELSKL

SEQ ID NO: 46 - protein, 439 aa, Homo sapiens
  MISC_FEATURE (1)..(439): Any "X" = any amino acid
ERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLIPFTLNFTITNLHYEENMQHPGSRKFNTMERVLQGCLVPCSRNTNVGLLYSGCRLTLLXXXXXXXXXXXXXXXXXXXXXXXXXXXXXXXXXXXXXXXXXXXXXGPYTLDRNSLYVNGFTHRSSVAPTSTPGTSTVDLGTSGTPSSLPSPTTVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQVTNGIKELGPYTLDRNSLYVNGFTHRSSGLTTSTPWTSTVDLGTSGTPSPVPSPTTAGPLLI

SEQ ID NO: 47 - protein, 1366 aa, Homo sapiens
ERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMERVLQGPLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTLNFTITNLQYEENMGHPGSRKFNITERVLQGLLNPIFKNSSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTEPGPLLIPFTLNFTITNLQYEEDMRRTGSRKFNTMERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLIPFTLNFTITNLQYEENMGHPGSRKFNITERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPKKDGAATGVDAICTHRLDPKSPGLNREQLYWELSKLTNDIEEVGPYTLDRNSLYVNGFTHRSFVAPTSTLGTSTVDLGTSGTPSSLPSPTTGVPLLIPFTLNFTITNLQYEENMGHPGSRKFNIMERVLQGLLSPIFKNSSVGSLYSGCRLTLLRPEKDGAATRVDAVCTHRPDPKSPGLDRERLYWKLSQLTHGIIELGPYTLDRHSFYVNGFTHQSSMTTTRTPDTSTMHLATSRTPASLSGPTTASPLLVLFTINFTITNQRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETSGTPASLP

SEQ ID NO: 48 - protein, 1148 aa, Homo sapiens
MPLFKNTSVSSLYSGCRLTLLRPEKDGAATRVDAVCTHRPDPKSPGLDRERLYWKLSQLTHGIIELGPYTLDRHSFYVNGFTHQSSMTTTRTPDTSTMHLATSRTPASLSGPTTASPLLVLFTINFTITNQRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETSGTPASLPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGHYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGSRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMKHLLSPLFQRSSLGARYTGCRVIALRSVKNGAETRVDLLCTYLQPLSGPGLPIKQVFHELSQQTHGITRLGPYSLDKDSLYLNGYNEPGLDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 49 - DNA, 6833 bp, Homo sapiens
gagagggttctgcagggtctgctcaaacccttgttcaggaatagcagtctggaatacctctattcaggctgcagactagcctcactcaggccagagaaggatagctcagccatggcagtggatgccatctgcacacatcgccctgaccctgaagacctcggactggacagagagcgactgtactgggagctgagcaatctgacaaatggcatccaggagctgggcccctacaccctggaccggaacagtctctatgtcaatggtttcacccatcgaagctctatgcccaccaccagcactcctgggacctccacagtggatgtgggaacctcagggactccatcctccagccccagccccacgactgctggccctctcctgatgccgttcaccctcaacttcaccatcaccaacctgcagtacgaggaggacatgcgtcgcactggctccaggaagttcaacaccatggagagggttctgcagggtccgcttagtcccatattcaagaactccagtgttggccctctgtactctggctgcagactgacctctctcaggcccgagaaggatggggcagcaactggaatggatgctgtctgcctctaccaccctaatcccaaaagacctgggctggacagagagcagctgtactgggagctaagccagctgacccacaacatcactgagctgggcccctacagcctggacagggacagtctctatgtcaatggtttcacccatcagaactctgtgcccaccaccagtactcctgggacctccacagtgtactgggcaaccactgggactccatcctccttccccggccacacagagcctggccctctcctgataccattcacgctcaacttcaccatcactaacctacagtatgaggagaacatgggtcaccctggctccaggaagttcaacatcacggagagggttctgcagggtctgcttaatcccattttcaagaactccagtgttggccctctgtactctggctgcagactgacctctctcaggcccgagaaggatggggcagcaactggaatggatgctgtctgcctctaccaccctaatcccaaaagacctgggctggacagagagcagctgtactgcgagctaagccagctgacccacaacatcactgagctgggcccctacagcttggacagggacagtctttatgtcaatggtttcacccatcagaactctgtgcccaccaccagtactcctgggacctccacagtgtactgggcaaccactgggactccatcctccttccccggccacacagagcctggccctctcctgataccattcaccctcaacttcaccatcaccaacctgcagtacgaggaggacatgcgtcgcactggctccaggaagttcaacaccatggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcgttacagagctgggcccctacaccctggacagggacagtctctatgtcaatggcttcacccatcggagctctgtgccaaccaccagtattcctgggacctctgcagtgcacctggaaacctctgggactccagcctccctccctggccacacagcccctggccctctcctggtgccattcaccctcaacttcactatcaccaacctgcagtatgaggaggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaaccctggactggacagagagcagctatactgggagctgagcaaactgacccgtggcatcatcgagctgggcccctacctcctggacagaggcagtctctatgtcaatggtttcacccatcggaactttgtgcccatcaccagcactcctgggacctccacagtacacctaggaacctctgaaactccatcctccctacctagacccatagtgcctggccctctcctgataccattcacactcaacttcaccatcactaacctacagtatgaggagaacatgggtcaccctggctccaggaagttcaacatcacggagagggttctgcagggtctgctcaaacccttgttcaggaatagcagtctggaatacctctattcaggctgcagactaacctcactcaggccagagaaggatagctcaaccatggcagtggatgccatctgcacacatcgccctgaccctgaagacctcggactggacagagagcgactgtactgggagctgagcaatctgacaaatggcatccaggagctgggcccctacaccctggaccggaacagtctctatgtcaatggtttcacccatcgaagctctatgcccaccaccagcactcctgggacctccacagtggatgtgggaacctcagggactccatcctccagccccagccccacgactgctggccctctcctgatgccgttcaccctcaacttcaccatcaccaacctgcagtacgaggaggacatgcgtcgcactggctccaggaagttcaacaccatggagagtgtcctgcagggtctgctcaagcccttgttcaagaacaccagtgttggccctctgtactctggctgcagattgaccttgctcaggcccaagaaagatggggcagccactggagtggatgccatctgcacccaccgccttgaccccaaaagccctggactcaacagggagcagctgtactgggagttaagcaaactgaccaatgacattgaagaggtgggcccctacaccttggacaggaacagtctctatgtcaatggtttcacccatcggagctttgtggcccccaccagcactcttgggacctccacagtggaccttgggacctcagggactccatcctccctccccagccccacaacaggtgttcctctcctgataccattcacactcaacttcaccatcactaacctacagtatgaggagaacatgggtcaccctggctccaggaagttcaacatcatggagagggttctgcagggtctgcttatgcccttgttcaagaacaccagtgtcagctctctgtactctggttgcagactgaccttgctcaggcctgagaaggatggggcagccaccagagtggttgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacctacgaccgccagccctctcctgataccattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctaacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggccactatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctccaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgaagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtctagatgagcctcctacaactcccaagccagccaccacattcctgcctcctctgtcagaagccacaacagccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacccgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcttcatcggcttggcaggactcctgggactcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcg

SEQ ID NO: 50 - protein, 2248 aa, Homo sapiens
ERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMERVLQGPLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTLNFTITNLQYEENMGHPGSRKFNITERVLQGLLNPIFKNSSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTEPGPLLIPFTLNFTITNLQYEEDMRRTGSRKFNTMERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLIPFTLNFTITNLQYEENMGHPGSRKFNITERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPKKDGAATGVDAICTHRLDPKSPGLNREQLYWELSKLTNDIEEVGPYTLDRNSLYVNGFTHRSFVAPTSTLGTSTVDLGTSGTPSSLPSPTTGVPLLIPFTLNFTITNLQYEENMGHPGSRKFNIMERVLQGLLSPIFKNSSVGSLYSGCRLTLLRPEKDGAATRVDAVCTHRPDPKSPGLDRERLYWKLSQLTHGIIELGPYTLDRHSFYVNGFTHQSSMTTTRTPDTSTMHLATSRTPASLSGPTTASPLLVLFTINFTITNQRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETSGTPASLPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGHYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGSRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMKHLLSPLFQRSSLGARYTGCRVIALRSVKNGAETRVDLLCTYLQPLSGPGLPIKQVFHELSQQTHGITRLGPYSLDKDSLYLNGYNEPGLDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 51 - DNA, 24 bp, Artificial Sequence
  Synthetic Primer
cagcagagaccagcacgagtactc

SEQ ID NO: 52 - DNA, 20 bp, Artificial Sequence
  Synthetic Primer
tccactgccatggctgagct

SEQ ID NO: 53 - DNA, 22 bp, Artificial Sequence
  Synthetic Primer
ccagcacagctcttcccaggac

SEQ ID NO: 54 - DNA, 22 bp, Artificial Sequence
  Synthetic Primer
ggaatggctgagctgacgtctg

SEQ ID NO: 55 - DNA, 21 bp, Artificial Sequence
  Synthetic Primer
cttcccaggacaacctcaagg

SEQ ID NO: 56 - DNA, 21 bp, Artificial Sequence
  Synthetic Primer
gcaggatgagtgagccacgtg

SEQ ID NO: 57 - DNA, 22 bp, Artificial Sequence
  Synthetic Primer
gtcagatctggtgacctcactg

SEQ ID NO: 58 - DNA, 21 bp, Artificial Sequence
  Synthetic Primer
gaggcactggaaagcccagag

SEQ ID NO: 59 - DNA, 25 bp, Artificial Sequence
  Synthetic Primer
ctgatggcattatggaacacatcac

SEQ ID NO: 60 - DNA, 22 bp, Artificial Sequence
  Synthetic Primer
cccagaacgagagaccagtgag

SEQ ID NO: 61 - DNA, 24 bp, Artificial Sequence
  Synthetic Primer
gctgatggcgatgaatgaacactg

SEQ ID NO: 62 - DNA, 22 bp, Artificial Sequence
  Synthetic Primer
cccagaacgagagaccagtgag

SEQ ID NO: 63 - DNA, 35 bp, Artificial Sequence
  Synthetic Primer
cgcggatccgaacactgcgtttgctggctttgatg

SEQ ID NO: 64 - DNA, 23 bp, Artificial Sequence
  Synthetic Primer
cctctgtgtgctgcttcattggg

SEQ ID NO: 65 - DNA, 32 bp, Artificial Sequence
  Synthetic Primer
accggatccatgggccacacagagcctggccc

SEQ ID NO: 66 - DNA, 29 bp, Artificial Sequence
  Synthetic Primer
tgtaagcttaggcagggaggatggagtcc

SEQ ID NO: 67 - DNA, 507 bp, Homo sapien
atgagaggatcgcatcaccatcaccatcacggatccatgggccacacagagcctggccctctcctgataccattcactttcaactttaccatcaccaacctgcattatgaggaaaacatgcaacaccctggttccaggaagttcaacaccacggagagggttctgcagggtctgctcaagcccttgttcaagaacaccagtgttggccctctgtactctggctgcagactgaccttgctcagacctgagaagcatgaggcagccactggagtggacaccatctgtacccaccgcgttgatcccatcggacctggactggacagagagcggctatactgggagctgagccagctgaccaacagcatcacagagctgggaccctacaccctggacagggacagtctctatgtcaatggcttcaaccctcggagctctgtgccaaccaccagcactcctgggacctccacagtgcacctggcaacctctgggactccatcctccctgcct

SEQ ID NO: 68 - protein, 169 aa, Homo sapiens
MRGSHHHHHHGSMGHTEPGPLLIPFTFNFTITNLHYEENMQHPGSRKFNTTERVLQGLLKPLFKNTSVGPLYSGCRLTLLRPEKHEAATGVDTICTHRVDPIGPGLDRERLYWELSQLTNSITELGPYTLDRDSLYVNGFNPRSSVPTTSTPGTSTVHLATSGTPSSLP

SEQ ID NO: 69 - protein, 909 aa, Homo sapiens
  MISC_FEATURE (1)..(909): Any "X" = any amino acid
ERVLQGLLGPMFKNTSVGLLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLIPFTINFTITNLRYEENMGHPGSRKFNIMERVLQGLLKPLFKNTSVGPLYSGCRLTLLRPKKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLIPFTINFTITNLRYEENMHHPGSRKFNTMERVLQGLLMPLFKNTSVSSLYSGCRLTLLRPEKDGAATRVDAVCTHRPDPKSPGLDRERLYWKLSQLTHGITELGPYTLDRNSLYVNGFTHRSSMPTTSTPGTSTVDVGTSGTPSSSPSPTTAGPLLMPFTLNFTITNLQYEEDMRRTGSRKFNTMERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLIPFTLNFTITNLHYEENMQHPGSRKFNTMERVLQGCLVPCSRNTNVGLLYSGCRLTLLRXEKXXAATXVDXXCXXXXDPXXPGLDREXLYWELSXLTXXIXELGPYTLDRNSLYVNGFTHRSSVAPTSTPGTSTVDLGTSGTPSSLPSPTTVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQVTNGIKELGPYTLDRNSLYVNGFTHRSSGLTTSTPWTSTVDLGTSGTPSPVPSPTTAGPLLI

SEQ ID NO: 70 - protein, 525 aa, Homo sapiens
QGLLGPMFKNTSVGLLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSVSSLYSGCRLTLLRPEKDGAATRVDAACTYRPDPKSPGLDREQLYWELSQLTHSITELGPYTLDRVSLYVNGFNPRSSVPTTSTPGTSTVHLATSGTPSSLPGHTAPVPLLIPFTLNFTITNLQYEEDMRHPGSRKFNTMERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTATGPLLIPFTPNFTITNLQYEEDMRRTGSRKFNTMERVLQGLLSPIFKNSSVGPLYSGCRLTSLRPEKDGAATGMDAVCLYHPNPKRPGLDREQLY

SEQ ID NO: 71 - protein, 594 aa, Homo sapiens
ERVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTIINLQYEEDMHRPGSRKFNTTERVLQGLLMPLFKNTSVGPLYSGCRLTLLRPEKQEAATGVDTICTHRLDPSEPGLDREQLYWELSQLTNSITELGPYTLDRDSLYVNGFTHSGVLCPPPSILGIFTVQPETFETPSSLPGPTATGPVLLPFTLNFTIINLQYEEDMHRPGSRKFNTTERVLQGLLTPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTHRLDPKSPGVDREQLYWELSQLTNGIKELGPYTLDRNSLYVNGFTHWIPVPTSSTPGTSTVDLGSGTPSSLPSPTTAGPL

SEQ ID NO: 72 - protein, 424 aa, Homo sapiens; identical to SEQ ID NO: 40

SEQ ID NO: 73 - protein, 286 aa, Homo sapiens
ERVLQGLLKPLFKSTSVGPLYSGCRLTLLRPEKRGAATGVDTICTHRLDPLNPGLDREQLYWELSKLTRGIIELGPYLLDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLIPF

SEQ ID NO: 74 - protein, 286 aa, Homo sapiens; identical to SEQ ID NO: 31

SEQ ID NO: 75 - protein, 286 aa, Homo sapiens; identical to SEQ ID NO: 26

SEQ ID NO: 76 - protein, 286 aa, Homo sapiens; identical to SEQ ID NO: 23

SEQ ID NO: 77 - protein, 288 aa, Homo sapiens; identical to SEQ ID NO: 34

SEQ ID NO: 78 - protein, 597 aa, Homo sapiens
ERVLHGLLTPLFKNTRVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITNLHYEENMQHPGSRKFNTTERVLQGLLKPLFKNTSVGPLYSGCRLTLFKPEKHEAATGVDAICTLRLDPTGPGLDRQLYWELSQLTNSVTELGPYTLDRDSLYVNGFTHRSSVPTTSIPGTSAVHLETSGTPASLPGHTAPGPLLIPFTLNFTITNLQYEEDMRRTGSRKFNTMERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLIPFTINFTITNLRYEENMHHPGSRKFNIMERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLIPF

SEQ ID NO: 79 - protein, 420 aa, Homo sapiens; identical to SEQ ID NO: 38

SEQ ID NO: 80 - protein, 479 aa, Homo sapiens
QLYWELSKLTNDIEELGPYTLDRNSLYVNGFTHQSSVSTTSTPGTSTVDLRTSGTPSSLSSPTIMAAGPLLIPFTLNFTITNLQYEENMGHPGSRKFNIMERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLIPFTLNFTITNLKYEEDMHCPGSRKFNTTERVLQSLFGPMFKNTSVGPLYSGCRLTLLRSEKDGAATGVDAICTHRLDPKSLGVDREQLYWELSQLTNGIKELGPYTLDRNSLYVNGFTHQTSAPNTSTPGTSTVDLGTSGTPSSLPSPTSAGPLLVPFTLNFTITNLQYEEDMRRTGSRKFNTMESVLQGLLKPLFKNTSVGPLYSGCRLTLLRPEKDGAATGVDAICTHRLDPKSPGLNREQLYWELSKL

SEQ ID NO: 81 - DNA, 5465 bp, Homo sapiens
cagagagcgttgagctgggaacagtgacaagtgcttatcaagttccttcactctcaacacggttgacaagaactgatggcattatggaacacatcacaaaaatacccaatgaagcagcacacagaggtaccataagaccagtcaaaggccctcagacatccacttcgcctgccagtcctaaaggactacacacaggagggacaaaaagaatggagaccaccaccacagctttgaagaccaccaccacagctttgaagaccacttccagagccaccttgaccaccagtgtctatactcccactttgggaacactgactcccctcaatgcatcaaggcaaatggccagcacaatcctcacagaaatgatgatcacaaccccatatgttttccctgatgttccagaaacgacatcctcattggctaccagcctgggagcagaaaccagcacagctcttcccaggacaaccccatctgttctcaatagagaatcagagaccacagcctcactggtctctcgttctggggcagagagaagtccggttattcaaactctagatgtttcttctagtgagccagatacaacagcttcatgggttatccatcctgcagagaccatcccaactgtttccaagacaacccccaattttttccacagtgaattagacactgtatcttccacagccaccagtcatggggcagacgtcagctcagccattccaacaaatatctcacctagtgaactagatgcactgaccccactggtcactatttcggggacagatactagtacaacattcccaacactgactaagtccccacatgaaacagagacaagaaccacatggctcactcatcctgcagagaccagctcaactattcccagaacaatccccaatttttctcatcatgaatcagatgccacaccttcaatagccaccagtcctggggcagaaaccagttcagctattccaattatgactgtctcacctggtgcagaagatctggtgacctcacaggtcactagttctgggacagacagaaatatgactattccaactttgactctttctcctggtgaaccaaagacgatagcctcattagtcacccatcctgaagcacagacaagttcggccattccaacttcaactatctcgcctgctgtatcacggttggtgacctcaatggtcaccagtttggcggcaaagacaagtacaactaatcgagctctgacaaactcccctggtgaaccagctacaacagtttcattggtcacgcatcctgcacagaccagcccaacagttccctggacaacttccatttttttccatagtaaatcagacaccacaccttcaatgaccaccagtcatggggcagaatccagttcagctgttccaactccaactgtttcaactgaggtaccaggagtagtgacccctttggtcaccagttctagggcagtgatcagtacaactattccaattctgactctttctcctggtgaaccagagaccacaccttcaatggccaccagtcatggggaagaagccagttctgctattccaactccaactgtttcacctggggtaccaggagtggtgacctctctggtcactagttctagggcagtgactagtacaactattccaattctgactttttctcttggtgaaccagagaccacaccttcaatggccaccagtcatgggacagaagctggctcagctgttccaactgttttacctgaggtaccaggaatggtgacctctctggttgctagttctagggcagtaaccagtacaactcttccaactctgactctttctcctggtgaaccagagaccacaccttcaatggccaccagtcatggggcagaagccagctcaactgttccaactgtttcacctgaggtaccaggagtggtgacctctctggtcactagttctagtggagtaaacagtacaagtattccaactctgattctttctcctggtgaactagaaaccacaccttcaatggccaccagtcatggggcagaagccagctcagctgttccaactccaactgtttcacctggggtatcaggagtggtgacccctctggtcactagttccagggcagtgaccagtacaactattccaattctaactctttcttctagtgagccagagaccacaccttcaatggccaccagtcatggggtagaagccagctcagctgttctaactgtttcacctgaggtaccaggaatggtgacctctctggtcactagttctagagcagtaaccagtacaactattccaactctgactatttcttctgatgaaccagagaccacaacttcattggtcacccattctgaggcaaagatgatttcagccattccaactttagctgtctcccctactgtacaagggctggtgacttcactggtcactagttctgggtcagagaccagtgcgttttcaaatctaactgttgcctcaagtcaaccagagaccatagactcatgggtcgctcatcctgggacagaagcaagttctgttgttccaactttgactgtctccactggtgagccgtttacaaatatctcattggtcacccatcctgcagagagtagctcaactcttcccaggacaacctcaaggttttcccacagtgaattagacactatgccttctacagtcaccagtcctgaggcagaatccagctcagccatttcaactactatttcacctggtataccaggtgtgctgacatcactggtcactagctctgggagagacatcagtgcaacttttccaacagtgcctgagtccccacatgaatcagaggcaacagcctcatgggttactcatcctgcagtcaccagcacaacagttcccaggacaacccctaattattctcatagtgaaccagacaccacaccatcaatagccaccagtcctggggcagaagccacttcagattttccaacaataactgtctcacctgatgtaccagatatggtaacctcacaggtcactagttctgggacagacaccagtataactattccaactctgactctttcttctggtgagccagagaccacaacctcatttatcacctattctgagacacacacaagttcagccattccaactctccctgtctcccctggtgcatcaaagatgctgacctcactggtcatcagttctgggacagacagcactacaactttcccaacactgacggagaccccatatgaaccagagacaacagccatacagctcattcatcctgcagagaccaacacaatggttcccaagacaactcccaagttttcccatagtaagtcagacaccacactcccagtagccatcaccagtcctgggccagaagccagttcagctgtttcaacgacaactatctcacctgatatgtcagatctggtgacctcactggtccctagttctgggacagacaccagtacaaccttcccaacattgagtgagaccccatatgaaccagagactacagtcacgtggctcactcatcctgcagaaaccagcacaacggtttctgggacaattcccaacttttcccataggggatcagacactgcaccctcaatggtcaccagtcctggagtagacacgaggtcaggtgttccaactacaaccatcccacccagtataccaggggtagtgacctcacaggtcactagttctgcaacagacactagtacagctattccaactttgactccttctcctggtgaaccagagaccacagcctcatcagctacccatcctgggacacagactggcttcactgttccaattcggactgttccctctagtgagccagatacaatggcttcctgggtcactcatcctccacagaccagcacacctgtttccagaacaacctccagtttttcccatagtagtccagatgccacacctgtaatggccaccagtcctaggacagaagccagttcagctgtactgacaacaatctcacctggtgcaccagagatggtgacttcacagatcactagttctggggcagcaaccagtacaactgttccaactttgactcattctcctggtatgccagagaccacagccttattgagcacccatcccagaacagggacaagtaaaacatttcctgcttcaactgtgtttcctcaagtatcagagaccacagcctcactcaccattagacctggtgcagagactagcacagctctcccaactcagacaacatcctctctcttcaccctacttgtaactggaaccagcagagttgatctaagtccaactgcttcacctggtgtttctgcaaaaacagccccactttccacccatccagggacagagaccagcacaatgattccaacttcaactctttcccttggtttactagagactacaggcttactggccaccagctcttcagcagagaccagcacgagtactctaactctgactgtttcccctgctgtctctgggctttccagtgcctctataacaactgataagccccaaactgtgacctcctggaacacagaaacctcaccatctgtaacttcagttggacccccagaattttccaggactgtcacaggcaccactatgaccttgataccatcagagatgccaacaccacctaaaaccagtcatggagaaggagtgagtccaaccactatcttgagaactacaatggttgaagccactaatttagctaccacaggttccagtcccactgtggccaagacaacaaccaccttcaatacactggctggaagcctctttactcctctgaccacacctgggatgtccaccttggcctctgagagtgtgacctcaagaacaagttataaccatcggtcctggatctccaccaccagcagttataaccgtcggtactggacccctgccaccagcactccagtgacttctacattctccccagggatttccacatcctccatccccagctccacagcagccacagtcccattcatggtgccattcaccctcaacttcaccatcaccaacctgcagtacgaggaggacatgcggcaccctggttccaggaagttcaacgccacagagagagaactgcagggtctgctcaaacccttgttcaggaatagcagtctggaatacctctattcaggctgcagactagcctcactcaggccagagaaggatagctcagccatggcagtggatgccatctgcacacatcgccctgaccctgaagacctcggactggacagagagcgactgtactgggagctgagcaatctgacaaatggcatccaggagctgggcccctacaccctggaccggaacagtctctatgtcaatggtttcacccatcgaagctctatgcccaccaccagcactcctgggacctccacagtggatgtgggaacctcagggactccatcctccagccccagccccacg

SEQ ID NO: 82 - protein, 1821 aa, Homo sapiens
ESVLEGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASRQMASTILTEMMITTPYVFPDVPETTSSLATSLGAETSTALPRTTPSVLNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPT

SEQ ID NO: 83 - DNA, 468 bp, Homo sapiens
gccacagtcccattcatggtgccattcaccctcaacttcaccatcaccaacctgcagtacgaggaggacatgcggcaccctggttccaggaagttcaacgccacagagagagaactgcagggtctgctcaaacccttgttcaggaatagcagtctggaatacctctattcaggctgcagactagcctcactcaggccagagaaggatagctcagccatggcagtggatgccatctgcatacatcgccctgaccctgaagacctcggactggacagagagcgactgtactgggagctgagcaatctgacaaatggcatccaggagctgggcccctacaccctggaccggaacagtctctatgtcaatggtttcacccatcgaagctctatgcccaccaccagcactcctgggacctccacagtggatgtgggaacctcagggactccatcctccagccccagccccacg

SEQ ID NO: 84 - DNA, 474 bp, Homo sapiens
gctgctggccctctcctgatgccgttcaccctcaacttcaccatcaccaacctgcagtacgaggaggacatgcgtcgcactggctccaggaagttcaacaccatggagagtgtcctgcagggtctgctcaagcccttgttcaagaacaccagtgttggccctctgtactctggctgcagattgaccttgctcaggcccaagaaagatggggcagccactggagtggatgccatctgcacccaccgccttgaccccaaaagccctggactcaacagggagcagctgtactgggagctaagcaaactgaccaatgacattgaagagctgggcccctacaccctggacaggaacagtctctatgtcaatggtttcacccatcagagctctgtgtccaccaccagcactcctgggacctccacagtggatctcagaacctcagggactccatcctccctctccagccccacaattatg

SEQ ID NO: 85 - DNA, 468 bp, Homo sapiens
gctgctggccctctcctggtaccattcaccctcaacttcaccatcaccaacctgcagtatggggaggacatgggtcaccctggctccaggaagttcaacaccacagagagggtcctgcagggtctgcttggtcccatattcaagaacaccagtgttggccctctgtactctggctgcagactgacctctctcaggtctgagaaggatggagcagccactggagtggatgccatctgcatccatcatcttgaccccaaaagccctggactcaacagagagcggctgtactgggagctgagccaactgaccaatggcatcaaagagctgggcccctacaccctggacaggaacagtctctatgtcaatggtttcacccatcggacctctgtgcccaccaccagcactcctgggacctccacagtggaccttggaacctcagggactccattctccctcccaagccccgca

SEQ ID NO: 86 - DNA, 465 bp, Homo sapiens
actgctggccctctcctggtgctgttcaccctcaacttcaccatcaccaacctgaagtatgaggaggacatgcatcgccctggctccaggaagttcaacaccactgagagggtcctgcagactctgcttggtcctatgttcaagaacaccagtgttggccttctgtactctggctgcagactgaccttgctcaggtccgagaaggatggagcagccactggagtggatgccatctgcacccaccgtcttgaccccaaaagccctggactggacagagagcagctatactgggagctgagccagctgaccaatggcatcaaagagctgggcccctacaccctggacaggaacagtctctatgtcaatggtttcacccattggatccctgtgcccaccagcagcactcctgggacctccacagtggaccttgggtcagggactccatcctccctccccagccccaca

SEQ ID NO: 87 - DNA, 468 bp, Homo sapiens
gctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtggaccttgggacctcagggactccatcctccctccccagccctaca

SEQ ID NO: 88 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacaccagtgttggccctctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtggaccttgggacctcagggactccatcctccctccccagccctaca

SEQ ID NO: 89 - DNA, 468 bp, Homo sapiens
tctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccactggaatggatgccatctgcagccaccgtcttgaccccaaaagccctggactcaacagagagcagctgtactgggagctgagccagctgacccatggcatcaaagagctgggcccctacaccctggacaggaacagtctctatgtcaatggtttcacccatcggagctctgtggcccccaccagcactcctgggacctccacagtggaccttgggacctcagggactccatcctccctccccagccccaca

SEQ ID NO: 90 - DNA, 468 bp, Homo sapiens
acagctgttcctctcctggtgccgttcaccctcaactttaccatcaccaatctgcagtatggggaggacatgcgtcaccctggctccaggaagttcaacaccacagagagggtcctgcagggtctgcttggtcccttgttcaagaactccagtgtcggccctctgtactctggctgcagactgatctctctcaggtctgagaaggatggggcagccactggagtggatgccatctgcacccaccaccttaaccctcaaagccctggactggacagggagcagctgtactggcagctgagccagatgaccaatggcatcaaagagctgggcccctacaccctggaccggaacagtctctacgtcaatggtttcacccatcggagctctgggctcaccaccagcactccttggacttccacagttgaccttggaacctcagggactccatcccccgtccccagccccaca

SEQ ID NO: 91 - DNA, 468 bp, Homo sapiens
actgctggccctctcctggtgccattcaccctcaacttcaccatcaccaacctgcagtatgaggaggacatgcatcgccctggatctaggaagttcaacaccacagagagggtcctgcagggtctgcttagtcccattttcaagaactccagtgttggccctctgtactctggctgcagactgacctctctcaggcccgagaaggatggggcagcaactggaatggatgctgtctgcctctaccaccctaatcccaaaagacctggactggacagagagcagctgtactgggagctaagccagctgacccacaacatcactgagctgggcccctacagcctggacagggacagtctctatgtcaatggtttcacccatcagaactctgtgcccaccaccagtactcctgggacctccacagtgtactgggcaaccactgggactccatcctccttccccggccacaca

SEQ ID NO: 92 - DNA, 468 bp, Homo sapiens
gagcctggccctctcctgataccattcactttcaactttaccatcaccaacctgcattatgaggaaaacatgcaacaccctggttccaggaagttcaacaccacggagagggttctgcagggtctgctcaagcccttgttcaagaacaccagtgttggccctctgtactctggctgcagactgacctctctcaggcccgagaaggatggggcagcaactggaatggatgctgtctgcctctaccaccctaatcccaaaagacctgggctggacagagagcagctgtactgggagctaagccagctgacccacaacatcactgagctgggcccctacagcctggacagggacagtctctatgtcaatggtttcacccatcagaactctgtgcccaccaccagtactcctgggacctccacagtgtactgggcaaccactgggactccatcctccttccccggccacaca

SEQ ID NO: 93 - DNA, 468 bp, Homo sapiens
gagcctggccctctcctgataccattcactttcaactttaccatcaccaacctgcattatgaggaaaacatgcaacaccctggttccaggaagttcaacaccacggagagggttctgcagggtctgctcaagcccttgttcaagaacaccagtgttggccctctgtactctggctgcagactgaccttgctcagacctgagaagcatgaggcagccactggagtggacaccatctgtacccaccgcgttgatcccatcggacctggactggacagggagcggctatactgggagctgagccagctgaccaacagcattaccgaactgggaccctacaccctggacagggacagtctctatgtcaatggcttcaaccctcggagctctgtgccaaccaccagcactcctgggacctccacagtgcacctggcaacctctgggactccatcctccctgcctggccacaca

SEQ ID NO: 94 - DNA, 468 bp, Homo sapiens
  misc_feature (1)..(468): All N's = any nucleotide
gcccctgtccctctcttgataccattcaccctcaactttaccatcaccaacctgcattatgaggaaaacatgcaacaccctggttccaggaagttcaacaccacggagagggttctgcagggtctgctcaagcccttgttcaagaacaccagtgttggccctctgtactctggctgcagactgaccttgctcagacctgagaagcatgaggcagccactggagtggacaccatctgtacccaccgcgttgatcccatcggacctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 95 - DNA, 468 bp, Homo sapiens
tctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccactggaatggatgccatctgcagccaccgtcttgaccccaaaagccctggactcgacagagagcagctgtactgggagctgagccagctgacccatggcatcaaagagctgggcccctacaccctggacaggaacagtctctatgtcaatggtttcacccatcggagctctgtggcccccaccagcactcctgggacctccacagtggaccttgggacctcagggactccatcctccctccccagccccaca

SEQ ID NO: 96 - DNA, 468 bp, Homo sapiens; identical to SEQ ID NO: 90

SEQ ID NO: 97 - DNA, 468 bp, Homo sapiens
actgctggccctctcctggtgccattcaccctaaacttcaccatcaccaacctgcagtatgaggaggacatgcatcgccctggatctaggaagttcaacgccacagagagggtcctgcagggtctgcttagtcccatattcaagaactccagtgttggccctctgtactctggctgcagactgacctctctcaggcccgagaaggatggggcagcaactggaatggatgctgtctgcctctaccaccctaatcccaaaagacctggactggacagagagcagctgtactgggagctaagccagctgacccacaacatcactgagctgggcccctacagcctggacagggacagtctctatgtcaatggtttcacccatcagagctctatgacgaccaccagaactcctgatacctccacaatgcacctggcaacctcgagaactccagcctccctgtctggacctacg

SEQ ID NO: 98 - DNA, 474 bp, Homo sapiens
accgccagccctctcctggtgctattcacaatcaactgcaccatcaccaacctgcagtacgaggaggacatgcgtcgcactggctccaggaagttcaacaccatggagagtgtcctgcagggtctgctcaagcccttgttcaagaacaccagtgttggccctctgtactctggctgcagattgaccttgctcaggcccaagaaagatggggcagccactggagtggatgccatctgcacccaccgccttgaccccaaaagccctggactcaacagggagcagctgtactgggagctaagcaaactgaccaatgacattgaagagctgggcccctacaccctggacaggaacagtctctatgtcaatggtttcacccatcagagctctgtgtccaccaccagcactcctgggacctccacagtggatctcagaacctcagggactccatcctccctctccagccccacaattatg

SEQ ID NO: 99 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagagggtcctacagggtctgctcaggcccttgttcaagaacaccagtgtcagctctctgtactctggttgcagactgaccttgctcaggcctgagaaggatggggcagccaccagagtggatgctgcctgcacctaccgccctgatcccaaaagccctggactggacagagagcaactatactgggagctgagccagctaacccacagcatcactgagctgggaccctacaccctggacagggtcagtctctatgtcaatggcttcaaccctcggagctctgtgccaaccaccagcactcctgggacctccacagtgcacctggcaacctctgggactccatcctccctgcctggccacaca

SEQ ID NO: 100 - DNA, 468 bp, Homo sapiens
gcccctgtccctctcttgataccattcaccctcaactttaccatcaccaacctgcattatgaagaaaacatgcaacaccctggttccaggaagttcaacaccacggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcgttacagagctgggcccctacaccctggacagggacagtctctatgtcaatggcttcacccagcggagctctgtgccaaccaccagtattcctgggacctctgcagtgcacctggaaacctctgggactccagcctccctccctggccacaca

SEQ ID NO: 101 - DNA, 468 bp, Homo sapiens
gcccctggccctctcctggtgccattcaccctcaacttcactatcaccaacctgcagtatgaggtggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaaccctggactggacagagagcagctatactgggagctgagcaaactgacccgtggcatcatcgagctgggcccctacctcctggacagaggcagtctctatgtcaatggtttcacccatcggaactttgtgcccatcaccagcactcctgggacctccacagtacacctaggaacctctgaaactccatcctccctacctagacccata

SEQ ID NO: 102 - DNA, 468 bp, Homo sapiens
gtgcctggccctctcctggtgccattcaccctcaacttcaccatcaccaacttgcagtatgaggaggccatgcgacaccctggctccaggaagttcaataccacggagagggtcctacagggtctgctcaggcccttgttcaagaataccagtatcggccctctgtactccagctgcagactgaccttgctcaggccagagaaggacaaggcagccaccagagtggatgccatctgtacccaccaccctgaccctcaaagccctggactgaacagagagcagctgtactgggagctgagccagctgacccacggcatcactgagctgggcccctacaccctggacagggacagtctctatgtcgatggtttcactcattggagccccataccgaccaccagcactcctgggacctccatagtgaacctgggaacctctgggatcccaccttccctccctgaaactaca

SEQ ID NO: 103 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagagggttctgcagggtctgctcaaacccttgttcaggaatagcagtctggaatacctctattcaggctgcagactagcctcactcaggccagagaaggatagctcagccatggcagtggatgccatctgcacacatcgccctgaccctgaagacctcggactggacagagagcgactgtactgggagctgagcaatctgacaaatggcatccaggagctgggcccctacaccctggaccggaacagtctctacgtcaatggtttcacccatcggagctctgggctcaccaccagcactccttggacttccacagttgaccttggaacctcagggactccatcccccgtccccagccccaca

SEQ ID NO: 104 - DNA, 468 bp, Homo sapiens
actgctggccctctcctggtgccattcaccctcaacttcaccatcaccaacctgcagtatgaggaggacatgcatcgccctggttccaggaggttcaacaccacggagagggttctgcagggtctgctcacgcccttgttcaagaacaccagtgttggccctctgtactctggctgcagactgaccttgctcagacctgagaagcaagaggcagccactggagtggacaccatctgtacccaccgcgttgatcccatcggacctggactggacagagagcggctatactgggagctgagccagctgaccaacagcatcacagagctgggaccctacaccctggatagggacagtctctatgtcaatggcttcaacccttggagctctgtgccaaccaccagcactcctgggacctccacagtgcacctggcaacctctgggactccatcctccctgcctggccacaca

SEQ ID NO: 105 - DNA, 468 bp, Homo sapiens
gcccctgtccctctcttgataccattcaccctcaactttaccatcaccgacctgcattatgaagaaaacatgcaacaccctggttccaggaagttcaacaccacggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcgttacagagctgggcccctacaccctggacagggacagtctctatgtcaatggcttcacccatcggagctctgtgccaaccaccagtattcctgggacctctgcagtgcacctggaaacctctgggactccagcctccctccctggccacaca

SEQ ID NO: 106 - DNA, 468 bp, Homo sapiens
gcccctggccctctcctggtgccattcaccctcaacttcactatcaccaacctgcagtatgaggaggacatgcgtcaccctggttccaggaagttcagcaccacggagagagtcctgcagggtctgctcaagcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacctacg

SEQ ID NO: 107 - DNA, 468 bp, Homo sapiens
accgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccacgctcaggcccaagaaggatggggcagccaccaaagtggatgccatctgcacctaccgccctgatcccaaaagccctggactggacagagagcagctatactgggagctgagccagctaacccacagcatcactgagctgggcccctacacccaggacagggacagtctctatgtcaatggcttcacccatcggagctctgtgccaaccaccagtattcctgggacctctgcagtgcacctggaaacctctgggactccagcctccctccctggccacaca

SEQ ID NO: 108 - DNA, 468 bp, Homo sapiens
gcccctggccctctcctggtgccattcaccctcaacttcactatcaccaacctgcagtatgaggaggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaacccaggactggacagagagcagctatactgggagctgagcaaactgacccgtggcatcatcgagctgggcccctacctcctggacagaggcagtctctatgtcaatggtttcacccatcggacctctgtgcccaccaccagcactcctgggacctccacagtggaccttggaacctcagggactccattctccctcccaagccccgca

SEQ ID NO: 109 - DNA, 465 bp, Homo sapiens
  misc_feature (1)..(465): All N's = any nucleotide
ncnnctgnccctctcctgntnccnttcaccntcaacttnaccatcaccaacctgcantangnggannacatgcnncncccnggntccaggaagttcaacaccacngagagggtcctgcagactctgcttggtcctatgttcaagaacaccagtgttggccttctgtactctggctgcagactgaccttgctcaggtccgagaaggatggagcagccactggagtggatgccatctgcacccaccgtcttgaccccaaaagccctggagtggacagggagcaactatactgggagctgagccagctgaccaatggcattaaagaactgggcccctacaccctggacaggaacagtctctatgtcaatgggttcacccattggatccctgtgcccaccagcagcactcctgggacctccacagtggaccttgggtcagggactccatcctccctccccagccccaca

SEQ ID NO: 110 - DNA, 468 bp, Homo sapiens
actgctggccctctcctggtgccgttcaccctcaacttcaccatcaccaacctgaagtacgaggaggacatgcattgccctggctccaggaagttcaacaccacagagagagtcctgcagagtctgcttggtcccatgttcaagaacaccagtgttggccctctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtggaccttgggacctcagggactccatcctccctccccagccctaca

SEQ ID NO: 111 - DNA, 465 bp, Homo sapiens
  misc_feature (1)..(465): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccattggatccctgtgcccaccagcagcactcctgggacctccacagtggaccttgggtcagggactccatcctccctccccagccccaca

SEQ ID NO: 112 - DNA, 468 bp, Homo sapiens
  misc_feature (1)..(468): All N's = any nucleotide
actgctggccctctcctggtgccgttcaccctcaacttcaccatcaccaacctgaagtacgaggaggacatgcattgccctggctccaggaagttcaacaccacagagagagtcctgcagagtctgcttggtcccatgttcaagaacaccagtgttggccctctgtactctggctgcagactgacctcgctcaggtccgagaaggatggagcagccactggagtggatgccatctgcacccaccgtgttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtgnacntnggnacctcngggactccatcctccntccccngccncaca

SEQ ID NO: 113 - DNA, 468 bp, Homo sapiens
  misc_feature (1)..(468): All N's = any nucleotide
tctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcaaccactggaatggatgccatctgcacccaccgtcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 114 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagagggttctgcagggtctgctcaaacccttgttcaggaatagcagtctggaatacctctattcaggctgcagactagcctcactcaggccagagaaggatagctcagccatggcagtggatgccatctgcacacatcgccctgaccctgaagacctcggactggacagagagcgactgtactgggagctgagcaatctgacaaatggcatccaggagctgggcccctacaccctggaccggaacagtctctatgtcaatggtttcacccatcgaagctctatgcccaccaccagcactcctgggacctccacagtggatgtgggaacctcagggactccatcctccagccccagccccacg

SEQ ID NO: 115 - DNA, 468 bp, Homo sapiens
actgctggccctctcctgataccattcaccctcaacttcaccatcaccaacctgcagtatggggaggacatgggtcaccctggctccaggaagttcaacaccacagagagggtcctgcagggtctgcttggtcccatattcaagaacaccagtgttggccctctgtactctggctgcagactgacctctctcaggtctgagaaggatggagcagccactggagtggatgccatctgcatccatcatcttgaccccaaaagccctggactcaacagagagcggctgtactgggagctgagccaactgaccaatggcatcaaagagctgggcccctacaccctggacaggaacagtctctatgtcaatggtttcacccatcggacctctgtgcccaccaccagcactcctgggacctccacagtggaccttggaacctcagggactccattctccctcccaagccccgca

SEQ ID NO: 116 - DNA, 468 bp, Homo sapiens
  misc_feature (1)..(468): All N's = any nucleotide
actgctggccctctcctggtgctgttcaccctcaacttcaccatcaccaacctgaagtatgaggaggacatgcatcgccctggctccaggaagttcaacaccactgagagggtcctgcagactctgcttggtcctatgttcaagaacaccagtgttggccttctgtactctggctgcagactgaccttgctcaggtccgagaaggatggagcagccactggagtggatgccatctgcacccaccgtcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 117 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctaacccacagcatcactgagctgggcccctacacccaggacagggacagtctctatgtcaatggcttcacccatcggagctctgtgccaaccaccagtattcctgggacctctgcagtgcacctggaaaccactgggactccatcctccttccccggccacaca

SEQ ID NO: 118 - DNA, 468 bp, Homo sapiens
gagcctggccctctcctgataccattcactttcaactttaccatcaccaacctgcgttatgaggaaaacatgcaacaccctggttccaggaagttcaacaccacggagagggttctgcagggtctgctcacgcccttgttcaagaacaccagtgttggccctctgtactctggctgcagactgaccttgctcagacctgagaagcaggaggcagccactggagtggacaccatctgtacccaccgcgttgatcccatcggacctggactggacagagagcggctatactgggagctgagccagctgaccaacagcatcacagagctgggaccctacaccctggatagggacagtctctatgtcgatggcttcaacccttggagctctgtgccaaccaccagcactcctgggacctccacagtgcacctggcaacctctgggactccatcccccctgcctggccacaca

SEQ ID NO: 119 - DNA, 468 bp, Homo sapiens
gcccctgtccctctcttgataccattcaccctcaactttaccatcaccgacctgcattatgaagaaaacatgcaacaccctggttccaggaagttcaacaccacggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcatcacagagctgggaccctacaccctggatagggacagtctctatgtcaatggcttcaacccttggagctctgtgccaaccaccagcactcctgggacctccacagtgcacctggcaacctctgggactccatcctccctgcctggccacaca

SEQ ID NO: 120 - DNA, 468 bp, Homo sapiens
  misc_feature (1)..(468): All N's = any nucleotide
actgctggccctctcctggtgccgttcaccctcaacttcaccatcaccaacctgaagtacgaggaggacatgcattgccctggctccaggaagttcaacaccacagagagagtcctgcagagtctgcatggtcccatgttcaagaacaccagtgttggccctctgtactctggctgcagactgaccttgctcaggtccgagaaggatggagcagccactggagtggatgccatctgcacccaccgtcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 121 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaacagcatcacagagctgggaccctacaccctggatagggacagtctctatgtcaatggtttcacccatcgaagctctatgcccaccaccagtattcctgggacctctgcagtgcacctggaaacctctgggactccagcctccctccctggccacaca

SEQ ID NO: 122 - DNA, 468 bp, Homo sapiens
  misc_feature (1)..(468): All N's = any nucleotide
gcccctggccctctcctggtgccattcaccctcaacttcactatcaccaacctgcagtatgaggaggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaaccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 123 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggttttcaccctcggagctctgtgccaaccaccagcactcctgggacctccacagtgcacctggcaacctctgggactccatcctccctgcctggccacaca

SEQ ID NO: 124 - DNA, 468 bp, Homo sapiens
  misc_feature (1)..(468): All N's = any nucleotide
gcccctgtccctctcttgataccattcaccctcaactttaccatcaccaacctgcattatgaagaaaacatgcaacaccctggttccaggaagttcaacaccacggagcgggtcctgcagggtctgcttggtcccatgttcaagaacacaagtgtcggccttctgtactctggctgcagactgaccttgctcaggcctgagaagaatggggcagccactggaatggatgccatctgcagccaccgtcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 125 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcagaactctgtgcccaccaccagtactcctgggacctccacagtgtactgggcaaccactgggactccatcctccttccccggccacaca

SEQ ID NO: 126 - DNA, 468 bp, Homo sapiens
  misc_feature (1)..(468): All N's = any nucleotide
gagcctggccctctcctgataccattcactttcaactttaccatcaccaacctgcattatgaggaaaacatgcaacaccctggttccaggaagttcaacaccacggagagggttctgcagggtctgctcacgcccttgttcaagaacaccagtgttggccctctgtactctggctgcagactgaccttgctcagacctgagaagcaggaggcagccactggagtggacaccatctgtacccaccgcgttgatcccatcggacctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 127 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcggagctctgtgccaaccaccagcagtcctgggacctccacagtgcacctggcaacctctgggactccatcctccctgcctggccacaca

SEQ ID NO: 128 - DNA, 468 bp, Homo sapiens
  misc_feature (1)..(468): All N's = any nucleotide
gcccctgtccctctcttgataccattcaccctcaactttaccatcaccaacctgcattatgaagaaaacatgcaacaccctggttccaggaagttcaacaccacggagagggttctgcagggtctgctcaagcccttgttcaagagcaccagtgttggccctctgtactctggctgcagactgaccttgctcagacctgagaaacatggggcagccactggagtggacgccatctgcaccctccgccttgatcccactggtcctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 129 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcggacctctgtgcccaccaccagcactcctgggacctccacagtgcacctggcaacctctgggactccatcctccctgcctggccacaca

SEQ ID NO: 130 - DNA, 468 bp, Homo sapiens
  misc_feature (1)..(468): All N's = any nucleotide
gcccctgtccctctcttgataccattcaccctcaactttaccatcaccaacctgcagtatgaggaggacatgcatcgccctggatctaggaagttcaacaccacagagagggtcctgcagggtctgcttagtcccattttcaagaactccagtgttggccctctgtactctggctgcagactgacctctctcaggcccgagaaggatggggcagcaactggaatggatgctgtctgcctctaccaccctaatcccaaaagacctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 131 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccattggagctctgggctcaccaccagcactccttggacttccacagttgaccttggaacctcagggactccatcccccgtccccagccccaca

SEQ ID NO: 132 - DNA, 468 bp, Homo sapiens
  misc_feature (1)..(468): All N's = any nucleotide
actgctggccctctcctggtgccattcaccctaaacttcaccatcaccaacctgcagtatgaggaggacatgcatcgccctggatctaggaagttcaacgccacagagagggtcctgcagggtctgcttagtcccatattcaagaacaccagtgttggccctctgtactctggctgcagactgaccttgctcagacctgagaagcaggaggcagccactggagtggacaccatctgtacccaccgcgttgatcccatcggacctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 133 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcggagctttgggctcaccaccagcactccttggacttccacagttgaccttggaacctcagggactccatcccccgtccccagccccaca

SEQ ID NO: 134 - DNA, 468 bp, Homo sapiens
  misc_feature (1)..(468): All N's = any nucleotide
actgctggccctctcctggtgccattcaccctaaacttcaccatcaccaacctgcagtatgaggaggacatgcatcgccctggctccaggaagttcaacaccacggagagggtccttcagggtctgcttacgcccttgttcaggaacaccagtgtcagctctctgtactctggttgcagactgaccttgctcaggcctgagaaggatggggcagccaccagagtggatgctgtctgcacccatcgtcctgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 135 - DNA, 465 bp, Homo sapiens; identical to SEQ ID NO: 111
  misc_feature (1)..(465): All N's = any nucleotide

SEQ ID NO: 136 - DNA, 468 bp, Homo sapiens
  misc_feature (1)..(468): All N's = any nucleotide
actgctggccctctcctggtaccattcaccctcaacttcaccatcaccaacctgcagtatggggaggacatgggtcaccctggctccaggaagttcaacaccacagagagggtcctgcagggtctgcttggtcccatattcaagaacaccagtgttggccctctgtactctggctgcagactgacctctctcaggtccgagaaggatggagcagccactggagtggatgccatctgcatccatcatcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 137 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcagacctttgcgcccaacaccagcactcctgggacctccacagtggaccttgggacctcagggactccatcctccctccccagccctaca

SEQ ID NO: 138 - DNA, 468 bp, Homo sapiens
  misc_feature (1)..(468): All N's = any nucleotide
tctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccaccagagtggatgctgtctgcacccatcgtcctgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 139 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagagggttctgcagggtctgctcaagcccttgttcaagagcaccagtgttggccctctgtattctggctgcagactgaccttgctcaggcctgagaaggacggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccaca

SEQ ID NO: 140 - DNA, 468 bp, Homo sapiens
gccactggccctgtcctgctgccattcaccctcaattttaccatcactaacctgcagtatgaggaggacatgcatcgccctggctccaggaagttcaacaccacggagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacctacg

SEQ ID NO: 141 - DNA, 468 bp, Homo sapiens
accgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctaacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcg

SEQ ID NO: 142 - DNA, 468 bp, Homo sapiens
gctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggccactatgccctggacaacgacagcctctttgtcaatggtttcactcatcggagctctgtgtccaccaccagcactcctgggacccccacagtgtatctgggagcatctaagactccagcctcgatatttggcccttca

SEQ ID NO: 143 - DNA, 399 bp, Homo sapiens
gctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctccaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagc

SEQ ID NO: 144 - DNA, 453 bp, Homo sapiens
accggggtggtcagcgaggagccattcacactgaacttcaccatcaacaacctgcgctacatggcggacatgggccaacccggctccctcaagttcaacatcacagacaacgtcatgaagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtctagatgagcctcctacaactcccaagccagccaccacattcctgcctcctctgtcagaagccacaaca

SEQ ID NO: 145 - DNA, 465 bp, Homo sapiens
gccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtac

SEQ ID NO: 146 - protein, 9799 aa, Homo sapiens
  MISC_FEATURE (1)..(9799): Any "X" = any amino acid
ATVPFMVPFTLNFTITNLQYEEDMRHPGSRKFNATERELQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTAAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLDREQLYWELSQLTNGIKELGPYTLDRNSLYVNGFTHWIPVPTSSTPGTSTVDLGSGTPSSLPSPTAAGPLLVPFTLNFTITNLQYEEDMHHPGSRKFNTTERVLQGLLGPMFKNTSVGLLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMRHPGSRKFNTTERVLQGLLKPLFKSTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTLLRPEKHEAATGVDTICTHRVDPIGPGLDRERLYWELSQLTNSITELGPYTLDRDSLYVNGFNPRSSVPTTSTPGTSTVHLATSGTPSSLPGHTAPVPLLIPFTLNFTITNLHYEENMQHPGSRKFNTTERVLQGLLKPLFKNTSVGPLYSGCRLTLLRPEKHEAATGVDTICTHRVDPIGPGLDREXLYWELSXLTXXIXELGPYXLDRXSLYVNGFXXXXXXXXTSTPGTSXVXLXTSGTPXXXPXXTSAGPLLVPFTLNFTITNLQYEEDMHHPGSRKFNTTERVLQGLLGPMFKNTSVGLLYSGCRLTLLRPEKNGAATGMDAICSHRLDPKSPGLDREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQSSMTTTRTPDTSTMHLATSRTPASLSGPTTASPLLVLFTINCTITNLQYEEDMRRTGSRKFNTMESVLQGLLKPLFKNTSVGPLYSGCRLTLLRPKKDGAATGVDAICTHRLDPKSPGLNREQLYWELSKLTNDIEELGPYTLDRNSLYVNGFTHQSSVSTTSTPGTSTVDLRTSGTPSSLSSPTIMXXXPLLXPFTLNFTITNLXYEEXMXXPGSRKFNTTERVLQGLLRPLFKNTSVSSLYSGCRLTLLRPEKDGAATRVDAACTYRPDPKSPGLDREQLYWELSQLTHSITELGPYTLDRVSLYVNGFNPRSSVPTTSTPGTSTVHLATSGTPSSLPGHTAPVPLLIPFTLNFTITNLHYEENMQHPGSRKFNTTERVLQGLLRPLFKSTSVGPLYSGCRLTLLRPEKHGAATGVDAICTLRLDPTGPGLDRERLYWELSQLTNSVTELGPYTLDRDSLYVNGFTQRSSVPTTSIPGTSAVHLETSGTPASLPGHTAPGPLLVPFTLNFTITNLQYEVDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTXXXPLLXPFTLNFTITNLXYEEXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSFLTTSTPWTSTVDLGTSGTPSPVPSPTTAGPLLVPFTLNFTITNLQYEEDMHRPGSRRFNTTERVLQGLLTPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFSTTERVLQGLLKPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNQRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRTSVPTTSTPGTSTVDLGTSGTPFSLPSPAXXXPLLXPFTLNFTITNLXYEEXMXXPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSLPSSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTSLRSEKDGAATGVDAICTHRVDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICTHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLIPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTTSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETTGTPSSFPGHTEPGPLLIPFTFNFTITNLRYEENMQHPGSRKFNTTERVLQGLLTPLFKNTSVGPLYSGCRLTLLRPEKQEAATGVDTICTHRVDPIGPGLDRERLYWELSQLTNSITELGPYTLDRDSLYVDGFNPWSSVPTTSTPGTSTVHLATSGTPSPLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSITELGPYTLDRDSLYVNGFNPWSSVPTTSTPGTSTVHLATSGTPSSLPGHTTAGPLLVPFTLNFTITNLKYEEDMHCPGSRKFNTTERVLQSLHGPMFKNTSVGPLYSGCRLTLLRSEKDGAATGVDAICTHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTNSITELGPYTLDRDSLYVNGFTHRSSMPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFHPRSSVPTTSTPGTSTVHLATSGTPSSLPGHTAPVPLLIPFTLNFTITNLHYEENMQHPGSRKFNTTERVLQGLLGPMFKNTSVGLLYSGCRLTLLRPEKNGAATGMDAICSHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHQNSVPTTSTPGTSTVYWATTGTPSSFPGHTEPGPLLIPFTFNFTITNLHYEENMQHPGSRKFNTTERVLQGLLTPLFKNTSVGPLYSGCRLTLLRPEKQEAATGVDTICTHRVDPIGPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHRSSVPTTSSPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTLRLDPTGPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHRTSVPTTSTPGTSTVHLATSGTPSSLPGHTAPVPLLIPFTLNFTITNLQYEEDMHRPGSRKFNTTERVLQGLLSPIFKNSSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHWSSGLTTSTPWTSTVDLGTSGTPSPVPSPTTAGPLLVPFTLNFTITNLQYEEDMHRPGSRKFNATERVLQGLLSPIFKNTSVGPLYSGCRLTLLRPEKQEAATGVDTICTHRVDPIGPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHRSFGLTTSTPWTSTVDLGTSGTPSPVPSPTTAGPLLVPFTLNFTITNLQYEEDMHRPGSRKFNTTERVLQGLLTPLFRNTSVSSLYSGCRLTLLRPEKDGAATRVDAVCTHRPDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHWIPVPTSSTPGTSTVDLGSGTPSSLPSPTTAGPLLVPFTLNFTITNLQYGEDMGHPGSRKFNTTERVLQGLLGPIFKNTSVGPLYSGCRLTSLRSEKDGAATGVDAICIHHLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHQTFAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATRVDAVCTHRPDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYNVGFTQRSSVPTTSVPGTPTVDLGTSGTPVSKPGPSAASPLLVLFTLNGTITNLRYEENMQHPGSRKFNTTERVLQGLLRSLFKSTSVGPLYSGCRLTLLRPEKDGTATGVDAICTHHPDPKSPRLDREQLYWELSQLTHNITELGHYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGSRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMKHLLSPLFQRSSLGARYTGCRVIALRSVKNGAETRVDLLCTYLQPLSGPGLPIKQVFHELSQQTHGITRLGPYSLDKDSLYLNGYNEPGLDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEY

SEQ ID NO: 147 - DNA, 1422 bp, Homo sapiens
gccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggactcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcggaaaaaaaaaaaaaaa

SEQ ID NO: 148 - protein, 439 aa, Homo sapiens
AMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 149 - protein, 1799 aa, Homo sapiens
RTDGIMEHITKIPNEAAHRGTIRPVKGPQTSTSPASPKGLHTGGTKRMETTTTALKTTTTALKTTSRATLTTSVYTPTLGTLTPLNASRQMASTILTEMMITTPYVFPDVPETTSSLATSLGAETSTALPRTTPSVLNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPT

SEQ ID NO: 150 - protein, 156 aa, Homo sapiens
EPGPLLIPFTFNFTITNLHYEENMQHPGSRKFNTTERVLQGLLKPLFKNTSVGPLYSGCRLTLLRPEKHEAATGVDTICTHRVDPIGPGLDRERLYWELSQLTNSITELGPYTLDRDSLYVNGFNPRSSVPTTSTPGTSTVHLATSGTPSSLPKLT

SEQ ID NO: 151 - DNA, 507 bp, Homo sapiens; identical to SEQ ID NO: 67
  CDS (1)..(507)

SEQ ID NO: 152 - protein, 169 aa, Homo sapiens; identical to SEQ ID NO: 68

SEQ ID NO: 153 - DNA, 507 bp, Homo sapiens
aggcagggaggatggagtcccagaggttgccaggtgcactgtggaggtcccaggagtgctggtggttggcacagagctccgagggttgaagccattgacatagagactgtccctgtccagggtgtagggtcccagctctgtgatgctgttggtcagctggctcagctcccagtatagccgctctctgtccagtccaggtccgatgggatcaacgcggtgggtacagatggtgtccactccagtggctgcctcatgcttctcaggtctgagcaaggtcagtctgcagccagagtacagagggccaacactggtgttcttgaacaagggcttgagcagaccctgcagaaccctctccgtggtgttgaacttcctggaaccagggtgttgcatgttttcctcataatgcaggttggtgatggtaaagttgaaagtgaatggtatcaggagagggccaggctctgtgtggcccatggatccgtgatggtgatggtgatgcgatcctctcat

SEQ ID NO: 154 - protein, 9 aa, Homo sapiens
RLYWELSQL

SEQ ID NO: 155 - protein, 9 aa, Homo sapiens
TLDRDSLYV

SEQ ID NO: 156 - protein, 9 aa, Homo sapiens
VLQGLLKPL

SEQ ID NO: 157 - protein, 9 aa, Homo sapiens
QLTNSITEL

SEQ ID NO: 158 - protein, 780 aa, Homo sapiens
ATVPFMVPFTLNFTITNLQYEEDMRHPGSRKFNATERELQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTAAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLDREQLYWELSQLTNGIKELGPYTLDRNSLYVNGFTHWIPVPTSSTPGTSTVDLGSGTPSSLPSPTAAGPLLVPFTLNFTITNLQYEEDMHHPGSRKFNTTERVLQGLLGPMFKNTSVGLLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPT

SEQ ID NO: 159 - protein, 780 aa, Homo sapiens
SAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTLLRPEKHEAATGVDTICTHRVDPIGPGLDRERLYWELSQLTNSITELGPYTLDRDSLYVNGFNPRSSVPTTSTPGTSTVHLATSGTPSSLPGHT

SEQ ID NO: 160 - protein, 624 aa, Homo sapiens
TAGPLLVPFTLNFTITNLQYEEDMHRPGSRRFNTTERVLQGLLTPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFSTTERVLQGLLKPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNQRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETSGTPASLPGHT

SEQ ID NO: 161 - protein, 468 aa, Homo sapiens
ATGPVLLPFTLNFTITNLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYNVGFTQRSSVPTTSVPGTPTVDLGTSGTPVSKPGPSAASPLLVLFTLNGTITNLRYEENMQHPGSRKFNTTERVLQGLLRSLFKSTSVGPLYSGCRLTLLRPEKDGTATGVDAICTHHPDPKSPRLDREQLYWELSQLTHNITELGHYALDNDSLFVNGFTHRSSVSTTSTPGTPTVYLGASKTPASIFGPS

SEQ ID NO: 162 - protein, 11721 aa, Homo sapiens
  MISC_FEATURE (1)..(11721): Any "X" = any amino acid
MEHITKIPNEAAHRGTIRPVKGPQTSTSPASPKGLHTGGTKRMETTTTALKTTTTALKTTSRATLTTSVYTPTLGTLTPLNASRQMASTILTEMMITTPYVFPDVPETTSSLATSLGAETSTALPRTTPSVLNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTAAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLDREQLYWELSQLTNGIKELGPYTLDRNSLYVNGFTHWIPVPTSSTPGTSTVDLGSGTPSSLPSPTAAGPLLVPFTLNFTITNLQYEEDMHHPGSRKFNTTERVLQGLLGPMFKNTSVGLLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMRHPGSRKFNTTERVLQGLLKPLFKSTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTLLRPEKHEAATGVDTICTHRVDPIGPGLDRERLYWELSQLTNSITELGPYTLDRDSLYVNGFNPRSSVPTTSTPGTSTVHLATSGTPSSLPGHTAPVPLLIPFTLNFTITNLHYEENMQHPGSRKFNTTERVLQGLLKPLFKNTSVGPLYSGCRLTLLRPEKHEAATGVDTICTHRVDPIGPGLDREXLYWELSXLTXXIXELGPYXLDRXSLYVNGFXXXXXXXXTSTPGTSXVXLXTSGTPXXXPXXTSAGPLLVPFTLNFTITNLQYEEDMHHPGSRKFNTTERVLQGLLGPMFKNTSVGLLYSGCRLTLLRPEKNGAATGMDAICSHRLDPKSPGLDREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQSSMTTTRTPDTSTMHLATSRTPASLSGPTTASPLLVLFTINCTITNLQYEEDMRRTGSRKFNTMESVLQGLLKPLFKNTSVGPLYSGCRLTLLRPKKDGAATGVDAICTHRLDPKSPGLNREQLYWELSKLTNDIEELGPYTLDRNSLYVNGFTHQSSVSTTSTPGTSTVDLRTSGTPSSLSSPTIMXXXPLLXPFTLNFTITNLXYEEXMXXPGSRKFNTTERVLQGLLRPLFKNTSVSSLYSGCRLTLLRPEKDGAATRVDAACTYRPDPKSPGLDREQLYWELSQLTHSITELGPYTLDRVSLYVNGFNPRSSVPTTSTPGTSTVHLATSGTPSSLPGHTXXXPLLXPFTLNFTITNLXYEEXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSFLTTSTPWTSTVDLGTSGTPSPVPSPTTAGPLLVPFTLNFTITNLQYEEDMHRPGSRRFNTTERVLQGLLTPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFSTTERVLQGLLKPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNQRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRTSVPTTSTPGTSTVDLGTSGTPFSLPSPAXXXPLLXPFTLNFTITNLXYEEXMXXPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSLPSSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTSLRSEKDGAATGVDAICTHRVDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICTHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLIPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTTSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETTGTPSSFPGHTEPGPLLIPFTFNFTITNLRYEENMQHPGSRKFNTTERVLQGLLTPLFKNTSVGPLYSGCRLTLLRPEKQEAATGVDTICTHRVDPIGPGLDRERLYWELSQLTNSITELGPYTLDRDSLYVDGFNPWSSVPTTSTPGTSTVHLATSGTPSPLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSITELGPYTLDRDSLYVNGFNPWSSVPTTSTPGTSTVHLATSGTPSSLPGHTTAGPLLVPFTLNFTITNLKYEEDMHCPGSRKFNTTERVLQSLHGPMFKNTSVGPLYSGCRLTLLRSEKDGAATGVDAICTHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTNSITELGPYTLDRDSLYVNGFTHRSSMPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFHPRSSVPTTSTPGTSTVHLATSGTPSSLPGHTAPVPLLIPFTLNFTITNLHYEENMQHPGSRKFNTTERVLQGLLGPMFKNTSVGLLYSGCRLTLLRPEKNGAATGMDAICSHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHQNSVPTTSTPGTSTVYWATTGTPSSFPGHTEPGPLLIPFTFNFTITNLHYEENMQHPGSRKFNTTERVLQGLLTPLFKNTSVGPLYSGCRLTLLRPEKQEAATGVDTICTHRVDPIGPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHRSSVPTTSSPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTLRLDPTGPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHRTSVPTTSTPGTSTVHLATSGTPSSLPGHTAPVPLLIPFTLNFTITNLQYEEDMHRPGSRKFNTTERVLQGLLSPIFKNSSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHWSSGLTTSTPWTSTVDLGTSGTPSPVPSPTTAGPLLVPFTLNFTITNLQYEEDMHRPGSRKFNATERVLQGLLSPIFKNTSVGPLYSGCRLTLLRPEKQEAATGVDTICTHRVDPIGPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHRSFGLTTSTPWTSTVDLGTSGTPSPVPSPTTAGPLLVPFTLNFTITNLQYEEDMHRPGSRKFNTTERVLQGLLTPLFRNTSVSSLYSGCRLTLLRPEKDGAATRVDAVCTHRPDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHWIPVPTSSTPGTSTVDLGSGTPSSLPSPTTAGPLLVPFTLNFTITNLQYGEDMGHPGSRKFNTTERVLQGLLGPIFKNTSVGPLYSGCRLTSLRSEKDGAATGVDAICIHHLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHQTFAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATRVDAVCTHRPDPKSPGLDREXLYWELSXLTXXIXELGPYXLDRXSLYVNGFXXXXXXXXTSTPGTSXVXLXTSGTPXXXPXXTAPVPLLIPFTLNFTITNLHYEENMQHPGSRKFNTTERVLQGLLRPLFKSTSVGPLYSGCRLTLLRPEKHGAATGVDAICTLRLDPTGPGLDRERLYWELSQLTNSVTELGPYTLDRDSLYVNGFTQRSSVPTTSIPGTSAVHLETSGTPASLPGHTAPGPLLVPFTLNFTITNLQYEVDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTXXXPLLXPFTLNFTITNLXYEEXMXXPGSRKFNTTERVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYNVGFTQRSSVPTTSVPGTPTVDLGTSGTPVSKPGPSAASPLLVLFTLNGTITNLRYEENMQHPGSRKFNTTERVLQGLLRSLFKSTSVGPLYSGCRLTLLRPEKDGTATGVDAICTHHPDPKSPRLDREQLYWELSQLTHNITELGHYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGSRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMKHLLSPLFQRSSLGARYTGCRVIALRSVKNGAETRVDLLCTYLQPLSGPGLPIKQVFHELSQQTHGITRLGPYSLDKDSLYLNGYNEPGLDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 163 - protein, 156 aa, Homo sapiens
TAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHT

SEQ ID NO: 164 - protein, 42 aa, Homo sapiens
ATVPFMVPFTLNFTITNLQYEEDMRHPGSRKFNATERELQGL

SEQ ID NO: 165 - protein, 42 aa, Homo sapiens
TAVPLLVPFTLNFTITNLQYGEDMRHPGSRKFNTTERVLQGL

SEQ ID NO: 166 - protein, 42 aa, Homo sapiens
VPGPLLVPFTLNFTITNLQYEEAMRHPGSRKFNTTERVLQGL

SEQ ID NO: 167 - protein, 42 aa, Homo sapiens
APGPLLVPFTLNFTITNLQYEEDMRHPGSRKFSTTERVLQGL

SEQ ID NO: 168 - protein, 42 aa, Homo sapiens
APGPLLVPFTLNFTITNLQYEEDMRHPGSRKFNTTERVLQGL

SEQ ID NO: 169 - protein, 42 aa, Homo sapiens
APGPLLVPFTLNFTITNLQYEVDMRHPGSRKFNTTERVLQGL

SEQ ID NO: 170 - protein, 42 aa, Homo sapiens
SAGPLLVPFTLNFTITNLQYEEDMRHPGSRKFNTTERVLQGL

SEQ ID NO: 171 - protein, 42 aa, Homo sapiens
AAGPLLMPFTLNFTITNLQYEEDMRRTGSRKFNTMESVLQGL

SEQ ID NO: 172 - protein, 42 aa, Homo sapiens
TASPLLVLFTINCTITNLQYEEDMRRTGSRKFNTMESVLQGL

SEQ ID NO: 173 - protein, 42 aa, Homo sapiens
AAGPLLVPFTLNFTITNLQYGEDMGHPGSRKFNTTERVLQGL

SEQ ID NO: 174 - protein, 42 aa, Homo sapiens
TAGPLLIPFTLNFTITNLQYGEDMGHPGSRKFNTTERVLQGL

SEQ ID NO: 175 - protein, 42 aa, Homo sapiens
TAGPLLVPFTLNFTITNLQYGEDMGHPGSRKFNTTERVLQGL

SEQ ID NO: 176 - protein, 42 aa, Homo sapiens
TAGPLLVLFTLNFTITNLKYEEDMHRPGSRKFNTTERVLQTL

SEQ ID NO: 177 - protein, 42 aa, Homo sapiens
TAGPLLVPFTLNFTITNLQYEEDMHRPGSRKFNATERVLQGL

SEQ ID NO: 178 - protein, 42 aa, Homo sapiens
TAGPLLVPFTLNFTITNLQYEEDMHRPGSRRFNTTERVLQGL

SEQ ID NO: 179 - protein, 42 aa, Homo sapiens
TAGPLLVPFTLNFTITNLQYEEDMHRPGSRKFNTTERVLQGL

SEQ ID NO: 180 - protein, 42 aa, Homo sapiens
APVPLLIPFTLNFTITNLQYEEDMHRPGSRKFNTTERVLQGL

SEQ ID NO: 181 - protein, 42 aa, Homo sapiens
ATGPVLLPFTLNFTITNLQYEEDMHRPGSRKFNTTERVLQGL

SEQ ID NO: 182 - protein, 42 aa, Homo sapiens
AAGPLLVPFTLNFTITNLQYEEDMHHPGSRKFNTTERVLQGL

SEQ ID NO: 183 - protein, 42 aa, Homo sapiens
SAGPLLVPFTLNFTITNLQYEEDMHHPGSRKFNTTERVLQGL

SEQ ID NO: 184 - protein, 42 aa, Homo sapiens
TASPLLVLFTINFTITNQRYEENMHHPGSRKFNTTERVLQGL

SEQ ID NO: 185 - protein, 42 aa, Homo sapiens
TASPLLVLFTINFTITNLRYEENMHHPGSRKFNTTERVLQGL

SEQ ID NO: 186 - protein, 42 aa, Homo sapiens
EPGPLLIPFTFNFTITNLHYEENMQHPGSRKFNTTERVLQGL

SEQ ID NO: 187 - protein, 42 aa, Homo sapiens
EPGPLLIPFTFNFTITNLRYEENMQHPGSRKFNTTERVLQGL

SEQ ID NO: 188 - protein, 42 aa, Homo sapiens
APVPLLIPFTLNFTITNLHYEENMQHPGSRKFNTTERVLQGL

SEQ ID NO: 189 - protein, 42 aa, Homo sapiens
APVPLLIPFTLNFTITDLHYEENMQHPGSRKFNTTERVLQGL

SEQ ID NO: 190 - protein, 42 aa, Homo sapiens
AASPLLVLFTLNGTITNLRYEENMQHPGSRKFNTTERVLQGL

SEQ ID NO: 191 - protein, 42 aa, Homo sapiens
TAGPLLVPFTLNFTITNLKYEEDMHCPGSRKFNTTERVLQSL

SEQ ID NO: 192 - protein, 41 aa, Homo sapiens
AASHLLILFTLNFTITNLRYEENMWPGSRKFNTTERVLQGL

SEQ ID NO: 193 - protein, 42 aa, Homo sapiens
TGVVSEEPFTLNFTINNLRYMADMGQPGSLKFNITDNVMKHL

SEQ ID NO: 194 - protein, 42 aa, Homo sapiens
AMGYHLKTLTLNFTISNLQYSPDMGKGSATFNSTEGVLQHLL

SEQ ID NO: 195 - protein, 23 aa, Homo sapiens
LKPLFRNSSLEYLYSGCRLASLR

SEQ ID NO: 196 - protein, 23 aa, Homo sapiens
LKPLFKNTSVSSLYSGCRLTLLR

SEQ ID NO: 197 - protein, 23 aa, Homo sapiens
LKPLFKNTSVGPLYSGCRLTLLR

SEQ ID NO: 198 - protein, 23 aa, Homo sapiens
LKPLFKSTSVGPLYSGCRLTLLR

SEQ ID NO: 199 - protein, 23 aa, Homo sapiens
LKPLFKSTSVGPLYSSCRLTLLR

SEQ ID NO: 200 - protein, 23 aa, Homo sapiens
LKPLFKNTSVGPLYSGCRLTSLR

SEQ ID NO: 201 - protein, 23 aa, Homo sapiens
LGPIFKNTSVGPLYSGCRLTSLR

SEQ ID NO: 202 - protein, 23 aa, Homo sapiens
LGPMFKNTSVGLLYSGCRLTLLR

SEQ ID NO: 203 - protein, 23 aa, Homo sapiens
LGPMFKNTSVGPLYSGCRLTLLR

SEQ ID NO: 204 - protein, 23 aa, Homo sapiens
LGPMFKNTSVGPLYSGCRLTSLR

SEQ ID NO: 205 - protein, 23 aa, Homo sapiens
LGPLFKNSSVGPLYSGCRLISLR

SEQ ID NO: 206 - protein, 23 aa, Homo sapiens
LGPLFKNSSVDPLYSGCRLTSLR

SEQ ID NO: 207 - protein, 23 aa, Homo sapiens
LSPIFKNSSVGPLYSGCRLTSLR

SEQ ID NO: 208 - protein, 23 aa, Homo sapiens
LSPIFKNTSVGPLYSGCRLTLLR

SEQ ID NO: 209 - protein, 23 aa, Homo sapiens
LSPLFQRSSLGARYTGCRVIALR

SEQ ID NO: 210 - protein, 23 aa, Homo sapiens
LRPLFKNTSVSSLYSGCRLTLLR

SEQ ID NO: 211 - protein, 23 aa, Homo sapiens
LRPLFKNTSVGPLYSGSRLTLLR

SEQ ID NO: 212 - protein, 23 aa, Homo sapiens
LRPLFKNTSIGPLYSSCRLTLLR

SEQ ID NO: 213 - protein, 23 aa, Homo sapiens
LRPLFKSTSVGPLYSGCRLTLLR

SEQ ID NO: 214 - protein, 23 aa, Homo sapiens
LRPVFKNTSVGLLYSGCRLTLLR

SEQ ID NO: 215 - protein, 23 aa, Homo sapiens
LRPVFKNTSVGPLYSGCRLTLLR

SEQ ID NO: 216 - protein, 23 aa, Homo sapiens
LRSLFKSTSVGPLYSGCRLTLLR

SEQ ID NO: 217 - protein, 23 aa, Homo sapiens
LRSLFKSTSVGPLYSGCRLTSLR

SEQ ID NO: 218 - protein, 23 aa, Homo sapiens
LTPLFKNTSVGPLYSGCRLTLLR

SEQ ID NO: 219 - protein, 23 aa, Homo sapiens
LTPLFRNTSVSSLYSGCRLTLLR

SEQ ID NO: 220 - protein, 23 aa, Homo sapiens
LMPLFKNTSVSSLYSGCRLTLLR

SEQ ID NO: 221 - protein, 22 aa, Homo sapiens
RPLFQKSSMGPFYLGCQLISLR

SEQ ID NO: 222 - protein, 58 aa, Homo sapiens
PEKDSSAMAVDAICTHRPDPEDLGLDRERLYWELSNLTNGIQELGPYTLDRNSLYVNG

SEQ ID NO: 223 - protein, 58 aa, Homo sapiens
PEKDGAATGVDAICTHRLDPKSPGLNREQLYWELSKLTNDIEELGPYTLDRNSLYVNG

SEQ ID NO: 224 - protein, 58 aa, Homo sapiens
PKKDGAATGVDAICTHRLDPKSPGLNREQLYWELSKLTNDIEELGPYTLDRNSLYVNG

SEQ ID NO: 225 - protein, 58 aa, Homo sapiens
PEKDGTATGVDAICTHHPDPKSPRLDREQLYWELSQLTHNITELGHYALDNDSLFVNG

SEQ ID NO: 226 - protein, 58 aa, Homo sapiens
PEKDGEATGVDAICTHRPDPTGPGLDREQLYLELSQLTHSITELGPYTLDRDSLYVNG

SEQ ID NO: 227 - protein, 58 aa, Homo sapiens
PEKDGAATGMDAVCLYHPNPKRPGLDREQLYWELSQLTHNITELGPYSLDRDSLYVNG

SEQ ID NO: 228 - protein, 58 aa, Homo sapiens
PEKDGAATGMDAVCLYHPNPKRPGLDREQLYCELSQLTHNITELGPYSLDRDSLYVNG

SEQ ID NO: 229 - protein, 58 aa, Homo sapiens
PEKDGAATRVDAACTYRPDPKSPGLDREQLYWELSQLTHSITELGPYTLDRVSLYVNG

SEQ ID NO: 230 - protein, 58 aa, Homo sapiens
PKKDGAATKVDAICTYRPDPKSPGLDREQLYWELSQLTHSITELGPYTQDRDSLYVNG

SEQ ID NO: 231 - protein, 58 aa, Homo sapiens
PKKDGAATKVDAICTYRPDPKSPGLDREQLYWELSQLTHSITELGPYTQDRDSLYNVG

SEQ ID NO: 232 - protein, 58 aa, Homo sapiens
PEKDGAATRVDAVCTHRPDPKSPGLDRERLYWKLSQLTHGITELGPYTLDRHSLYVNG

SEQ ID NO: 233 - protein, 58 aa, Homo sapiens
PEKDGVATRVDAICTHRPDPKIPGLDRQQLYWELSQLTHSITELGPYTLDRDSLYVNG

SEQ ID NO: 234 - protein, 58 aa, Homo sapiens
SEKDGAATGVDAICIHHLDPKSPGLNRERLYWELSQLTNGIKELGPYTLDRNSLYVNG

SEQ ID NO: 235 - protein, 58 aa, Homo sapiens
SEKDGAATGVDAICTHRLDPKSPGLDREQLYWELSQLTNGIKELGPYTLDRNSLYVNG

SEQ ID NO: 236 - protein, 58 aa, Homo sapiens
SEKDGAATGVDAICTHRLDPKSPGVDREQLYWELSQLTNGIKELGPYTLDRNSLYVNG

SEQ ID NO: 237 - protein, 58 aa, Homo sapiens
SEKDGAATGVDAICTHRVDPKSPGVDREQLYWELSQLTNGIKELGPYTLDRNSLYVNG

SEQ ID NO: 238 - protein, 58 aa, Homo sapiens
SEKDGAATGVDAICTHHLNPQSPGLDREQLYWQLSQMTNGIKELGPYTLDRNSLYVNG

SEQ ID NO: 239 - protein, 58 aa, Homo sapiens
PEKRGAATGVDTICTHRLDPLNPGLDREQLYWELSKLTRGIIELGPYLLDRGSLYVNG

SEQ ID NO: 240 - protein, 58 aa, Homo sapiens
PEKNGAATGMDAICSHRLDPKSPGLNREQLYWELSQLTHGIKELGPYTLDRNSLYVNG

SEQ ID NO: 241 - protein, 58 aa, Homo sapiens
PEKNGAATGMDAICSHRLDPKSPGLDREQLYWELSQLTHGIKELGPYTLDRNSLYVNG

SEQ ID NO: 242 - protein, 58 aa, Homo sapiens
PEKHGAATGVDAICTLRLDPTGPGLDRERLYWELSQLTNSVTELGPYTLDRDSLYVNG

SEQ ID NO: 243 - protein, 58 aa, Homo sapiens
PEKHGAATGVDAICTLRLDPTGPGLDRERLYWELSQLTNSITELGPYTLDRDSLYVNG

SEQ ID NO: 244 - protein, 58 aa, Homo sapiens
PEKHEAATGVDTICTHRVDPIGPGLDRERLYWELSQLTNSITELGPYTLDRDSLYVNG

SEQ ID NO: 245 - protein, 58 aa, Homo sapiens
PEKQEAATGVDTICTHRVDPIGPGLDRERLYWELSQLTNSITELGPYTLDRDSLYVNG

SEQ ID NO: 246 - protein, 58 aa, Homo sapiens
PEKQEAATGVDTICTHRVDPIGPGLDRERLYWELSQLTNSITELGPYTLDRDSLYVDG

SEQ ID NO: 247 - protein, 58 aa, Homo sapiens
PEKDKAATRVDAICTHHPDPQSPGLNREQLYWELSQLTHGITELGPYTLDRDSLYVDG

SEQ ID NO: 248 - protein, 58 aa, Homo sapiens
SVKNGAETRVDLLCTYLQPLSGPGLPIKQVFHELSQQTHGITRLGPYSLDKDSLYLNG

SEQ ID NO: 249 - protein, 58 aa, Homo sapiens
PEKDGAATGVDTTCTYHPDPVGPGLDIQQLYWELSQLTHGVTQLGFYVLDRDSLFING

SEQ ID NO: 250 - protein, 12 aa, Homo sapiens
FTHRSSMPTTST

SEQ ID NO: 251 - protein, 12 aa, Homo sapiens
FTHRSSMPTTSI

SEQ ID NO: 252 - protein, 12 aa, Homo sapiens
FTHRTSVPTSST

SEQ ID NO: 253 - protein, 12 aa, Homo sapiens
FTHRTSVPTTST

SEQ ID NO: 254 - protein, 12 aa, Homo sapiens
FTHRSSVPTTSS

SEQ ID NO: 255 - protein, 12 aa, Homo sapiens
FTHRSSVSTTST

SEQ ID NO: 256 - protein, 12 aa, Homo sapiens
FTHRSSVAPTST

SEQ ID NO: 257 - protein, 12 aa, Homo sapiens
FTHRSSGLTTST

SEQ ID NO: 258 - protein, 12 aa, Homo sapiens
FTHRSFGLTTST

SEQ ID NO: 259 - protein, 12 aa, Homo sapiens
FTHRSSFLTTST

SEQ ID NO: 260 - protein, 12 aa, Homo sapiens
FTHRNFVPITST

SEQ ID NO: 261 - protein, 12 aa, Homo sapiens
FTHRSSVPTTSI

SEQ ID NO: 262 - protein, 12 aa, Homo sapiens
FTHQSSVSTTST

SEQ ID NO: 263 - protein, 12 aa, Homo sapiens
FTHQTSAPNTST

SEQ ID NO: 264 - protein, 12 aa, Homo sapiens
FTHQTFAPNTST

SEQ ID NO: 265 - protein, 12 aa, Homo sapiens
FTHQNSVPTTST

SEQ ID NO: 266 - protein, 12 aa, Homo sapiens
FTHQSSMTTTRT

SEQ ID NO: 267 - protein, 12 aa, Homo sapiens
FTHWIPVPTSST

SEQ ID NO: 268 - protein, 12 aa, Homo sapiens
FTHWSPIPTTST

SEQ ID NO: 269 - protein, 12 aa, Homo sapiens
FTHWSSGLTTST

SEQ ID NO: 270 - protein, 12 aa, Homo sapiens
FHPRSSVPTTST

SEQ ID NO: 271 - protein, 12 aa, Homo sapiens
FNPRSSVPTTST

SEQ ID NO: 272 - protein, 12 aa, Homo sapiens
FNPWSSVPTTST

SEQ ID NO: 273 - protein, 12 aa, Homo sapiens
FTQRSSVPTTSI

SEQ ID NO: 274 - protein, 12 aa, Homo sapiens
FTQRSSVPTTST

SEQ ID NO: 275 - protein, 12 aa, Homo sapiens
FTQRSSVPTTSV

SEQ ID NO: 276 - protein, 12 aa, Homo sapiens
YNEPGLDEPPTT

SEQ ID NO: 277 - protein, 12 aa, Homo sapiens
YAPQNLSIRGEY

SEQ ID NO: 278 - protein, 21 aa, Homo sapiens
PGTSTVDVGTSGTPSSSPSPT

SEQ ID NO: 279 - protein, 23 aa, Homo sapiens
PGTSTVDLRTSGTPSSLSSPTIM

SEQ ID NO: 280 - protein, 21 aa, Homo sapiens
PGTSTVDLGTSGTPFSLPSPA

SEQ ID NO: 281 - protein, 20 aa, Homo sapiens
PGTSTVDLGSGTPSSLPSPT

SEQ ID NO: 282 - protein, 20 aa, Homo sapiens
PGTSTVDLGSGTPSLPSSPT

SEQ ID NO: 283 - protein, 21 aa, Homo sapiens
PGTSTVDLGTSGTPSSLPSPT

SEQ ID NO: 284 - protein, 21 aa, Homo sapiens
PGTPTVDLGTSGTPVSKPGPS

SEQ ID NO: 285 - protein, 21 aa, Homo sapiens
PWTSTVDLGTSGTPSPVPSPT

SEQ ID NO: 286 - protein, 21 aa, Homo sapiens
PGTSTVYWATTGTPSSFPGHT

SEQ ID NO: 287 - protein, 21 aa, Homo sapiens
PGTSTVHLATSGTPSSLPGHT

SEQ ID NO: 288 - protein, 21 aa, Homo sapiens
PGTSTVHLATSGTPSPLPGHT

SEQ ID NO: 289 - protein, 21 aa, Homo sapiens
PDTSTMHLATSRTPASLSGPT

SEQ ID NO: 290 - protein, 21 aa, Homo sapiens
PGTSAVHLETSGTPASLPGHT

SEQ ID NO: 291 - protein, 21 aa, Homo sapiens
PGTSAVHLETTGTPSSFPGHT

SEQ ID NO: 292 - protein, 21 aa, Homo sapiens
PGTSTVHLGTSETPSSLPRPI

SEQ ID NO: 293 - protein, 21 aa, Homo sapiens
PGTSIVNLGTSGIPPSLPETT

SEQ ID NO: 294 - protein, 21 aa, Homo sapiens
PGTFTVQPETSETPSSLPGPT

SEQ ID NO: 295 - protein, 21 aa, Homo sapiens
PGTPTVDLGTSGTPVSKPGPS

SEQ ID NO: 296 - protein, 21 aa, Homo sapiens
PGTPTVYLGASKTPASIFGPS

SEQ ID NO: 297 - protein, 16 aa, Homo sapiens
PKPATTFLPPLSEATT

SEQ ID NO: 298 - protein, 21 aa, Homo sapiens
QINFHIVNWNLSNPDPTSSEY

SEQ ID NO: 299 - protein, 1794 aa, Homo sapiens
MEHITKIPNEAAHRGTIRPVKGPQTSTSPASPKGLHTGGTKRMETTTTALKTTTTALKTTSRATLTTSVYTPTLGTLTPLNASRQMASTILTEMMITTPYVFPDVPETTSSLATSLGAETSTALPRTTPSVLNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPT

SEQ ID NO: 300 - protein, 284 aa, Homo sapiens
ITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 301 - DNA, 24 bp, Artificial Sequence
  Synthetic primer
gtctctatgtcaatggtttcaccc

SEQ ID NO: 302 - DNA, 21 bp, Artificial Sequence
  Synthetic primer
tagctgctctctgtccagtcc

SEQ ID NO: 303 - DNA, 22 bp, Artificial Sequence
  Synthetic primer
ggacaaggtcaccacactctac

SEQ ID NO: 304 - DNA, 24 bp, Artificial Sequence
  Synthetic primer
gcagatcctccaggtctaggtgtg

SEQ ID NO: 305 - DNA, 24 bp, Artificial Sequence
  Synthetic primer
gtctctatgtcaatggtttcaccc

SEQ ID NO: 306 - DNA, 21 bp, Artificial Sequence
  Synthetic primer
tagctgctctctgtccagtcc

SEQ ID NO: 307 - DNA, 468 bp, Homo sapiens
actgctggccctctcctggtgccattcaccctcaacttcaccatcaccaacctgcagtatgaggaggacatgcatcgccctggatctaggaagttcaacaccacagagagggtcctgcagggtctgcttagtcccatattcaagaacaccagtgttggccctctgtactctggctgcagactgacctctctcaggtctgagaaggatggagcagccactggagtggatgccatctgcatccatcatcttgaccccaaaagccctggactcaacagagagcggctgtactgggagctgagccgactgaccaatggcatcaaagagctgggcccctacaccctggacaggaacagtctctatgtcaatggtttcacccatcggacctctgtgcccaccaccagcactcctgggacctccacagtggaccttggaacctcagggactccattctccctcccaagccccgca

SEQ ID NO: 308 - protein, 156 aa, Homo sapiens
TAGPLLVPFTLNFTITNLQYEEDMHRPGSRKFNTTERVLQGLLSPIFKNTSVGPLYSGCRLTSLRSEKDGAATGVDAICIHHLDPKSPGLNRERLYWELSRLTNGIKELGPYTLDRNSLYVNGFTHRTSVPTTSTPGTSTVDLGTSGTPFSLPSPA

SEQ ID NO: 309 - DNA, 31497 bp, Homo sapiens
  CDS (205)..(31497)
aagcgttgcacaattcccccaacctccatacatacggcagctcttctagacacaggttttcccaggtcaaatgcggggaccccagccatatctcccaccctgagaaattttggagtttcagggagctcagaagctctgcagaggccaccctctctgaggggattcttcttagacctccatccagaggcaaatgttgacctgtccatgctgaaaccctcaggccttcctgggtcatcttctcccacccgctccttgatgacagggagcaggagcactaaagccacaccagaaatggattcaggactgacaggagccaccttgtcacctaagacatctacaggtgcaatcgtggtgacagaacatactctgccctttacttccccagataagaccttggccagtcctacatcttcggttgtgggaagaaccacccagtctttgggggtgatgtcctctgctctccctgagtcaacctctagaggaatgacacactccgagcaaagaaccagcccatcgctgagtccccaggtcaatggaactccctctaggaactaccctgctacaagcatggtttcaggattgagttccccaaggaccaggaccagttccacagaaggaaattttaccaaagaagcatctacatacacactcactgtagagaccacaagtggcccagtcactgagaagtacacagtccccactgagacctcaacaactgaaggtgacagcacagagaccccctgggacacaagatatattcctgtaaaaatcacatctccaatgaaaacatttgcagattcaactgcatccaaggaaaatgccccagtgtctatgactccagctgagaccacagttactgactcacatactccaggaaggacaaacccatcatttgggacactttattcttccttccttgacctatcacctaaagggaccccaaattccagaggtgaaacaagcctggaactgattctatcaaccactggatatcccttctcctctcctgaacctggctctgcaggacacagcagaataagtaccagtgcgcctttgtcatcatctgcttcagttctcgataataaaatatcagagaccagcatattctcaggccagagtctcacctcccctctgtctcctggggtgcccgaggccagagccagcacaatgcccaactcagctatccctttttccatgacactaagcaatgcagaaacaagtgccgaaagggtcagaagcacaatttcctctctggggactccatcaatatccacaaagcagacagcagagactatccttaccttccatgccttcgctgagaccatggatatacccagcacccacatagccaagactttggcttcagaatggttgggaagtccaggtacccttggtggcaccagcacttcagcgctgacaaccacatctccatctaccactttagtctcagaggagaccaacacccatcactccacgagtggaaaggaaacagaaggaactttgaatacatctatgactccacttgagacctctgctcctggagaagagtccgaaatgactgccaccttggtccccactctaggttttacaactcttgacagcaagatcagaagtccatctcaggtctcttcatcccacccaacaagagagctcagaaccacaggcagcacctctgggaggcagagttccagcacagctgcccacgggagctctgacatcctgagggcaaccacttccagcacctcaaaagcatcatcatggaccagtgaaagcacagctcagcaatttagtgaaccccagcacacacagtgggtggagacaagtcctagcatgaaaacagagagacccccagcatcaaccagtgtggcagcccctatcaccacttctgttccctcagtggtctctggcttcaccaccctgaagaccagctccacaaaagggatttggcttgaagaaacatctgcagacacactcatcggagaatccacagctggcccaaccacccatcagtttgctgttcccactgggatttcaatgacaggaggcagcagcaccaggggaagccagggcacaacccacctactcaccagagccacagcatcatctgagacatccgcagatttgactctggccacgaacggtgtcccagtctccgtgtctccagcagtgagcaagacggctgctggctcaagtcctccaggagggacaaagccatcatatacaatggtttcttctgtcatccctgagacatcatctctacagtcctcagctttcagggaaggaaccagcctgggactgactccattaaacactagacatcccttctcttcccctgaaccagactctgcaggacacaccaagataagcaccagcattcctctgttgtcatctgcttcagttcttgaggataaagtgtcagcgaccagcacattctcacaccacaaagccacctcatctattaccacagggactcctgaaatctcaacaaagacaaagcccagctcagccgttctttcctccatgaccctaagcaatgcagcaacaagtcctgaaagagtcagaaatgcaacttcccctctgactcatccatctccatcaggggaagagacagcagggagtgtcctcactctcagcacctctgctgagactacagactcacctaacatccacccaactgggacactgacttcagaatcgtcagagagtcctagcactctcagcctcccaagtgtctctggagtcaaaaccacattttcttcatctactccttccactcatctatttactagtggagaagaaacagaggaaacttcgaatccatctgtgtctcaacctgagacttctgtttccagagtaaggaccaccttggccagcacctctgtccctaccccagtattccccaccatggacacctggcctacacgttcagctcagttctcttcatcccacctagtgagtgagctcagagctacgagcagtacctcagttacaaactcaactggttcagctcttcctaaaatatctcacctcactgggacggcaacaatgtcacagaccaatagagacacgtttaatgactctgctgcaccccaaagcacaacttggccagagactagtcccagattcaagacagggttaccttcagcaacaaccactgtttcaacctctgccacttctctctctgctactgtaatggtctctaaattcacttctccagcaactagttccatggaagcaacttctatcagggaaccatcaacaaccatcctcacaacagagaccacgaatggcccaggctctatggctgtggcttctaccaacatcccaattggaaagggctacattactgaaggaagattggacacaagccatctgcccattggaaccacagcttcctctgagacatctatggattttaccatggccaaagaaagtgtctcaatgtcagtatctccatctcagtccatggatgctgctggctcaagcactccaggaaggacaagccaattcgttgacacattttctgatgatgtctatcatttaacatccagagaaattacaatacctagagatggaacaagctcagctctgactccacaaatgactgcaactcaccctccatctcctgatcctggctctgctagaagcacctggcttggcatcttgtcctcatctccttcttctcctactcccaaagtcacaatgagctccacattttcaactcagagagtcaccacaagcatgataatggacacagttgaaactagtcggtggaacatgcccaacttaccttccacgacttccctgacaccaagtaatattccaacaagtggtgccataggaaaaagcaccctggttcccttggacactccatctccagccacatcattggaggcatcagaagggggacttccaaccctcagcacctaccctgaatcaacaaacacacccagcatccacctcggagcacacgctagttcagaaagtccaagcaccatcaaacttaccatggcttcagtagtaaaacctggctcttacacacctctcaccttcccctcaatagagacccacattcatgtatcaacagccagaatggcttactcttctgggtcttcacctgagatgacagctcctggagagactaacactggtagtacctgggaccccaccacctacatcaccactacggatcctaaggatacaagttcagctcaggtctctacaccccactcagtgaggacactcagaaccacagaaaaccatccaaagacagagtccgccaccccagctgcttactctggaagtcctaaaatctcaagttcacccaatctcaccagtccggccacaaaagcatggaccatcacagacacaactgaacactccactcaattacattacacaaaattggcagaaaaatcatctggatttgagacacagtcagctccaggacctgtctctgtagtaatccctacctcccctaccattggaagcagcacattggaactaacttctgatgtcccaggggaacccctggtccttgctcccagtgagcagaccacaatcactctccccatggcaacatggctgagtaccagtttgacagaggaaatggcttcaacagaccttgatatttcaagtccaagttcacccatgagtacatttgctatttttccacctatgtccacaccttctcatgaactttcaaagtcagaggcagataccagtgccattagaaatacagattcaacaacgttggatcagcacctaggaatcaggagtttgggcagaactggggacttaacaactgttcctatcaccccactgacaaccacgtggaccagtgtgattgaacactcaacacaagcacaggacaccctttctgcaacgatgagtcctactcacgtgacacagtcactcaaagatcaaacatctataccagcctcagcatccccttcccatcttactgaagtctaccctgagctcgggacacaagggagaagctcctctgaggcaaccactttttggaaaccatctacagacacactgtccagagagattgagactggcccaacaaacattcaatccactccacccatggacaacacaacaacagggagcagtagtagtggagtcaccctgggcatagcccaccttcccataggaacatcctccccagctgagacatccacaaacatggcactggaaagaagaagttctacagccactgtctctatggctgggacaatgggactccttgttactagtgctccaggaagaagcatcagccagtcattaggaagagtttcctctgtcctttctgagtcaactactgaaggagtcacagattctagtaagggaagcagcccaaggctgaacacacagggaaatacagctctctcctcctctcttgaacccagctatgctgaaggaagccagatgagcacaagcatccctctaacctcatctcctacaactcctgatgtggaattcatagggggcagcacattttggaccaaggaggtcaccacagttatgacctcagacatctccaagtcttcagcaaggacagagtccagctcagctacccttatgtccacagctttgggaagcactgaaaatacaggaaaagaaaaactcagaactgcctctatggatcttccatctccaactccatcaatggaggtgacaccatggatttctctcactctcagtaatgcccccaataccacagattcacttgacctcagccatggggtgcacaccagctctgcagggactttggccactgacaggtcattgaatactggtgtcactagagcctccagattggaaaacggctctgatacctcttctaagtccctgtctatgggaaacagcactcacacttccatgactgacacagagaagagtgaagtgtcttcttcaatccatccccgacctgagacctcagctcctggagcagagaccactttgacttccactcctggaaacagggccataagcttaacattgcctttttcatccattccagtggaagaagtcatttctacaggcataacctcaggaccagacatcaactcagcacccatgacacattctcccatcaccccaccaacaattgtatggaccagtacaggcacaattgaacagtccactcaaccactacatgcagtttcttcagaaaaagtttctgtgcagacacagtcaactccatatgtcaactctgtggcagtgtctgcttcccctacccatgagaattcagtctcttctggaagcagcacatcctctccatattcctcagcctcacttgaatccttggattccacaatcagtaggaggaatgcaatcacttcctggctatgggacctcactacatctctccccactacaacttggccaagtactagtttatctgaggcactgtcctcaggccattctggggtttcaaacccaagttcaactacgactgaatttccactcttttcagctgcatccacatctgctgctaagcaaagaaatccagaaacagagacccatggtccccagaatacagccgcgagtactttgaacactgatgcatcctcggtcacaggtctttctgagactcctgtgggggcaagtatcagctctgaagtccctcttccaatggccataacttctagatcagatgtttctggccttacatctgagagtactgctaacccgagtttaggcacagcctcttcagcagggaccaaattaactaggacaatatccctgcccacttcagagtctttggtttcctttagaatgaacaaggatccatggacagtgtcaatccctttggggtcccatccaactactaatacagaaacaagcatcccagtaaacagcgcaggtccacctggcttgtccacagtagcatcagatgtaattgacacaccttcagatggggctgagagtattcccactgtctccttttccccctcccctgatactgaagtgacaactatctcacatttcccagaaaagacaactcattcatttagaaccatttcatctctcactcatgagttgacttcaagagtgacacctattcctggggattggatgagttcagctatgtctacaaagcccacaggagccagtccctccattacactgggagagagaaggacaatcacctctgctgctccaaccacttcccccatagttctcactgctagtttcacagagaccagcacagtttcactggataatgaaactacagtaaaaacctcagatatccttgacgcacggaaaacaaatgagctcccctcagatagcagttcttcttctgatctgatcaacacctccatagcttcttcaactatggatgtcactaaaacagcctccatcagtcccactagcatctcaggaatgacagcaagttcctccccatctctcttctcttcagatagaccccaggttcccacatctacaacagagacaaatacagccacctctccatctgtttccagtaacacctattctcttgatgggggctccaatgtgggtggcactccatccactttaccaccctttacaatcacccaccctgtcgagacaagctcggccctattagcctggtctagaccagtaagaactttcagcaccatggtcagcactgacactgcctccggagaaaatcctacctctagcaattctgtggtgacttctgttccagcaccaggtacatggaccagtgtaggcagtactactgacttacctgccatgggctttctcaagacaagtcctgcaggagaggcacactcacttctagcatcaactattgaaccagccactgccttcactccccatctctcagcagcagtggtcactggatccagtgctacatcagaagccagtcttctcactacgagtgaaagcaaagccattcattcttcaccacagaccccaactacacccacctctggagcaaactgggaaacttcagctactcctgagagccttttggtagtcactgagacttcagacacaacacttacctcaaagattttggtcacagataccatcttgttttcaactgtgtccacgccaccttctaaatttccaagtacggggactctgtctggagcttccttccctactttactcccggacactccagccatccctctcactgccactgagccaacaagttcattagctacatcctttgattccaccccactggtgactatagcttcggatagtcttggcacagtcccagagactaccctgaccatgtcagagacctcaaatggtgatgcactggttcttaagacagtaagtaacccagataggagcatccctggaatcactatccaaggagtaacagaaagtccactccatccttcttccacttccccctctaagattgttgctccacggaatacaacctatgaaggttcgatcacagtggcactttctactttgcctgcgggaactactggttcccttgtattcagtcagagttctgaaaactcagagacaacggctttggtagactcatcagctgggcttgagagggcatctgtgatgccactaaccacaggaagccagggtatggctagctctggaggaatcagaagtgggtccactcactcaactggaaccaaaacattttcttctctccctctgaccatgaacccaggtgaggttacagccatgtctgaaatcaccacgaacagactgacagctactcaatcaacagcacccaaagggatacctgtgaagcccaccagtgctgagtcaggcctcctaacacctgtctctgcctcctcaagcccatcaaaggcctttgcctcactgactacagctcccccaacttgggggatcccacagtctaccttgacatttgagttttctgaggtcccaagtttggatactaagtccgcttctttaccaactcctggacagtccctgaacaccattccagactcagatgcaagcacagcatcttcctcactgtccaagtctccagaaaaaaacccaagggcaaggatgatgacttccacaaaggccataagtgcaagctcatttcaatcaacaggttttactgaaacccctgagggatctgcctccccttctatggcagggcatgaacccagagtccccacttcaggaacaggggaccctagatatgcctcagagagcatgtcttatccagacccaagcaaggcatcatcagctatgacatcgacctctcttgcatcaaaactcacaactctcttcagcacaggtcaagcagcaaggtctggttctagttcctctcccataagcctatccactgagaaagaaacaagcttcctttcccccactgcatccacctccagaaagacttcactatttcttgggccttccatggcaaggcagcccaacatattggtgcatcttcagacttcagctctgacactttctccaacatccactctaaatatgtcccaggaggagcctcctgagttaacctcaagccagaccattgcagaagaagagggaacaacagctgaaacacagacgttaaccttcacaccatctgagaccccaacatccttgttacctgtctcttctcccacagaacccacagccagaagaaagagttctccagaaacatgggcaagctctatttcagttcctgccaagacctccttggttgaaacaactgatggaacgctagtgaccaccataaagatgtcaagccaggcagcacaaggaaattccacgtggcctgccccagcagaggagacggggaccagtccagcaggcacatccccaggaagcccagaaatgtctaccactctcaaaatcatgagctccaaggaacccagcatcagcccagagatcaggtccactgtgcgaaattctccttggaagactccagaaacaactgttcccatggagaccacagtggaaccagtcacccttcagtccacagccctaggaagtggcagcaccagcatctctcacctgcccacaggaaccacatcaccaaccaagtcaccaacagaaaatatgttggctacagaaagggtctccctctccccatccccacctgaggcttggaccaacctttattctggaactccaggagggaccaggcagtcactggccacaatgtcctctgtctccctagagtcaccaactgctagaagcatcacagggactggtcagcaaagcagtccagaactggtttcaaagacaactggaatggaattctctatgtggcatggctctactggagggaccacaggggacacacatgtctctctgagcacatcttccaatatccttgaagaccctgtaaccagcccaaactctgtgagctcattgacagataaatccaaacataaaaccgagacatgggtaagcaccacagccattccctccactgtcctgaataataagataatggcagctgaacaacagacaagtcgatctgtggatgaggcttattcatcaactagttcttggtcagatcagacatctgggagtgacatcacccttggtgcatctcctgatgtcacaaacacattatacatcacctccacagcacaaaccacctcactagtgtctctgccctctggagaccaaggcattacaagcctcaccaatccctcaggaggaaaaacaagctctgcgtcatctgtcacatctccttcaatagggcttgagactctgagggccaatgtaagtgcagtgaaaagtgacattgcccctactgctgggcatctatctcagacttcatctcctgcggaagtgagcatcctggacgtaaccacagctcctactccaggtatctccaccaccatcaccaccatgggaaccaactcaatctcaactaccacacccaacccagaagtgggtatgagtaccatggacagcaccccggccacagagaggcgcacaacttctacagaacacccttccacctggtcttccacagctgcatcagattcctggactgtcacagacatgacttcaaacttgaaagttgcaagatctcctggaacaatttccacaatgcatacaacttcattcttagcctcaagcactgaattagactccatgtctactccccatggccgtataactgtcattggaaccagcctggtcactccatcctctgatgcttcagctgtaaagacagagaccagtacaagtgaaagaacattgagtccttcagacacaactgcatctactcccatctcaactttttctcgtgtccagaggatgagcatctcagttcctgacattttaagtacaagttggactcccagtagtacagaagcagaagatgtgcctgtttcaatggtttctacagatcatgctagtacaaagactgacccaaatacgcccctgtccacttttctgtttgattctctgtccactcttgactgggacactgggagatctctgtcatcagccacagccactacctcagctcctcagggggccacaactccccaggaactcactttggaaaccatgatcagcccagctacctcacagttgcccttctctatagggcacattacaagtgcagtcacaccagctgcaatggcaaggagctctggagttactttttcaagaccagatcccacaagcaaaaaggcagagcagacttccactcagcttcccaccaccacttctgcacatccagggcaggtgcccagatcagcagcaacaactctggatgtgatcccacacacagcaaaaactccagatgcaacttttcagagacaagggcagacagctcttacaacagaggcaagagctacatctgactcctggaatgagaaagaaaaatcaaccccaagtgcaccttggatcactgagatgatgaattctgtctcagaagataccatcaaggaggttaccagctcctccagtgtattaaaggaccctgaatacgctggacataaacttggaatctgggacgacttcatccccaagtttggaaaagcagcccatatgagagagttgccccttctgagtccaccacaggacaaagaggcaattcacccttctacaaacacagtagagaccacaggctgggtcacaagttccgaacatgcttctcattccactatcccagcccactcagcgtcatccaaactcacatctccagtggttacaacctccaccagggaacaagcaatagtttctatgtcaacaaccacatggccagagtctacaagggctagaacagagcctaattccttcttgactattgaactgagggacgtcagcccttacatggacaccagctcaaccacacaaacaagtattatctcttccccaggttccactgcgatcaccaaggggcctagaacagaaattacctcctctaagagaatatccagctcattccttgcccagtctatgaggtcgtcagacagcccctcagaagccatcaccaggctgtctaactttcctgccatgacagaatctggaggaatgatccttgctatgcaaacaagtccacctggcgctacatcactaagtgcacctactttggatacatcagccacagcctcctggacagggactccactggctacgactcagagatttacatactcagagaagaccactctctttagcaaaggtcctgaggatacatcacagccaagccctccctctgtggaagaaaccagctcttcctcttccctggtacctatccatgctacaacctcgccttccaatattttgttgacatcacaagggcacagtccctcctctactccacctgtgacctcagttttcttgtctgagacctctggcctggggaagaccacagacatgtcgaggataagcttggaacctggcacaagtttacctcccaatttgagcagtacagcaggtgaggcgttatccacttatgaagcctccagagatacaaaggcaattcatcattctgcagacacagcagtgacgaatatggaggcaaccagttctgaatattctcctatcccaggccatacaaagccatccaaagccacatctccattggttacctcccacatcatgggggacatcacttcttccacatcagtatttggctcctccgagaccacagagattgagacagtgtcctctgtgaaccagggacttcaggagagaagcacatcccaggtggccagctctgctacagagacaagcactgtcattacccatgtgtctagtggtgatgctactactcatgtcaccaagacacaagccactttctctagcggaacatccatctcaagccctcatcagtttataacttctaccaacacatttacagatgtgagcaccaacccctccacctctctgataatgacagaatcttcaggagtgaccatcaccacccaaacaggtcctactggagctgcaacacagggtccatatctcttggacacatcaaccatgccttacttgacagagactccattagctgtgactccagattttatgcaatcagagaagaccactctcataagcaaaggtcccaaggatgtgacctggacaagccctccctctgtggcagaaaccagctatccctcttccctgacacctttcttggtcacaaccatacctcctgccacttccacgttacaagggcaacatacatcctctcctgtttctgcgacttcagttcttacctctggactggtgaagaccacagatatgttgaacacaagcatggaacctgtgaccaattcacctcaaaatttgaacaatccatcaaatgagatactggccactttggcagccaccacagatatagagactattcatccttccataaacaaagcagtgaccaatatggggactgccagttcagcacatgtactgcattccactctcccagtcagctcagaaccatctacagccacatctccaatggttcctgcctccagcatgggggacgctcttgcttctatatcaatacctggttctgagaccacagacattgagggagagccaacatcctccctgactgctggacgaaaagagaacagcaccctccaggagatgaactcaactacagagtcaaacatcatcctctccaatgtgtctgtgggggctattactgaagccacaaaaatggaagtcccctcttttgatgcaacattcataccaactcctgctcagtcaacaaagttcccagatattttctcagtagccagcagtagactttcaaactctcctcccatgacaatatctacccacatgaccaccacccagacagggtcttctggagctacatcaaagattccacttgccttagacacatcaaccttggaaacctcagcagggactccatcagtggtgactgaggggtttgcccactcaaaaataaccactgcaatgaacaatgatgtcaaggacgtgtcacagacaaaccctccctttcaggatgaagccagctctccctcttctcaagcacctgtccttgtcacaaccttaccttcttctgttgctttcacaccgcaatggcacagtacctcctctcctgtttctatgtcctcagttcttacttcttcactggtaaagaccgcaggcaaggtggatacaagcttagaaacagtgaccagttcacctcaaagtatgagcaacactttggatgacatatcggtcacttcagcagccaccacagatatagagacaacgcatccttccataaacacagtagttaccaatgtggggaccaccggttcagcatttgaatcacattctactgtctcagcttacccagagccatctaaaagtcacattctcccaatgttaccacctccaccatggaagacaccacaatttccacgatcaatacctaaatcctctaagactacaagaactgagactgagacaacttcctccctgactcctaaactgagggagaccagcatctcccaggagatcacctcgtccacagagacaagcactgttccttacaaagagctcactggtgccactaccgaggtatccaggacagatgtcacttcctctagcagtacatccttccctggccctgatcagtccacagtgtcactagacatctccacagaaaccaacaccaggctgtctacctccccaataatgacagaatctgcagaaataaccatcaccacccaaacaggtcctcatggggctacatcacaggatacttttaccatggacccatcaaatacaaccccccaggcagggatccactcagctatgactcatggattttcacaattggatgtgaccactcttatgagcagaattccacaggatgtatcatggacaagtcctccctctgtggataaaaccagctccccctcttcctttctgtcctcacctgcaatgaccacaccttccctgatttcttctaccttaccagaggataagctctcctctcctatgacttcacttctcacctctggcctagtgaagattacagacatattacgtacacgcttggaacctgtgaccagctcacttccaaatttcagcagcacctcagataagatactggccacttctaaagacagtaaagacacaaaggaaatttttccttctataaacacagaagagaccaatgtgaaagccaacaactctggacatgaatcccattcccctgcactggctgactcagagacacccaaagccacaactcaaatggttatcaccaccactgtgggagatccagctccttccacatcaatgccagtgcatggttcctctgagactacaaacattaagagagagccaacatatttcttgactcctagactgagagagaccagtacctctcaggagtccagctttcccacggacacaagttttctactttccaaagtccccactggtactattactgaggtctccagtacaggggtcaactcttctagcaaaatttccaccccagaccatgataagtccacagtgccacctgacaccttcacaggagagatccccagggtcttcacctcctctattaagacaaaatctgcagaaatgacgatcaccacccaagcaagtcctcctgagtctgcatcgcacagtacccttcccttggacacatcaaccacactttcccagggagggactcattcaactgtgactcagggattcccatactcagaggtgaccactctcatgggcatgggtcctgggaatgtgtcatggatgacaactccccctgtggaagaaaccagctctgtgtcttccctgatgtcttcacctgccatgacatccccttctcctgtttcctccacatcaccacagagcatcccctcctctcctcttcctgtgactgcacttcctacttctgttctggtgacaaccacagatgtgttgggcacaacaagcccagagtctgtaaccagttcacctccaaatttgagcagcatcactcatgagagaccggccacttacaaagacactgcacacacagaagccgccatgcatcattccacaaacaccgcagtgaccaatgtagggacttccgggtctggacataaatcacaatcctctgtcctagctgactcagagacatcgaaagccacacctctgatgagtaccacctccaccctgggggacacaagtgtttccacatcaactcctaatatctctcagactaaccaaattcaaacagagccaacagcatccctgagccctagactgagggagagcagcacgtctgagaagaccagctcaacaacagagacaaatactgccttttcttatgtgcccacaggtgctattactcaggcctccagaacagaaatctcctctagcagaacatccatctcagaccttgatcggcccacaatagcacccgacatctccacaggaatgatcaccaggctcttcacctcccccatcatgacaaaatctgcagaaatgaccgtcaccactcaaacaactactcctggggctacatcacagggtatccttccttgggacacatcaaccacacttttccagggagggactcattcaaccgtgtctcagggattcccacactcagagataaccactcttcggagcagaacccctggagatgtgtcatggatgacaactccccctgtggaagaaaccagctctgggttttccctgatgtcaccttccatgacatccccttctcctgtttcctccacatcaccagagagcatcccctcctctcctctccctgtgactgcacttcttacttctgttctggtgacaaccaccaatgtattgggcacaacaagcccagagaccgtaacgagttcacctccaaatttaagcagccccacacaggagagactgaccacttacaaagacactgcgcacacagaagccatgcatgcttccatgcatacaaacactgcagtggccaacgtcgggacctccatttctggacatgaatcacaatcttctgtcccagctgattcacacacatccaaagccacatctccaatgggtatcaccttcgccatgggggatacaagtgtttctacatcaactcctgccttctttgagactagaattcagactgaatcaacatcctctttgattcctggattaagggacaccaggacgtctgaggagatcaacactgtgacagagaccagcactgtcctttcagaagtgcccactactactactactgaggtctccaggacagaagttatcacttccagcagaacaaccatctcagggcctgatcattccaaaatgtcaccctacatctccacagaaaccatcaccaggctctccacttttccttttgtaacaggatccacagaaatggccatcaccaaccaaacaggtcctatagggactatctcacaggctacccttaccctggacacatcaagcacagcttcctgggaagggactcactcacctgtgactcagagatttccacactcagaggagaccactactatgagcagaagtactaagggcgtgtcatggcaaagccctccctctgtggaagaaaccagttctccttcttccccagtgcctttacctgcaataacctcacattcatctctttattccgcagtatcaggaagtagccccacttctgctctccctgtgacttcccttctcacctctggcaggaggaagaccatagacatgttggacacacactcagaacttgtgaccagctccttaccaagtgcaagtagcttctcaggtgagatactcacttctgaagcctccacaaatacagagacaattcacttttcagagaacacagcagaaaccaatatggggaccaccaattctatgcataaactacattcctctgtctcaatccactcccagccatccggacacacacctccaaaggttactggatctatgatggaggacgctattgtttccacatcaacacctggttctcctgagactaaaaatgttgacagagactcaacatcccctctgactcctgaactgaaagaggacagcaccgccctggtgatgaactcaactacagagtcaaacactgttttctccagtgtgtccctggatgctgctactgaggtctccagggcagaagtcacctactatgatcctacattcatgccagcttctgctcagtcaacaaagtccccagacatttcacctgaagccagcagcagtcattctaactctcctcccttgacaatatctacacacaagaccatcgccacacaaacaggtccttctggggtgacatctcttggccaactgaccctggacacatcaaccatagccacctcagcaggaactccatcagccagaactcaggattttgtagattcagaaacaaccagtgtcatgaacaatgatctcaatgatgtgttgaagacaagccctttctctgcagaagaagccaactctctctcttctcaggcacctctccttgtgacaacctcaccttctcctgtaacttccacattgcaagagcacagtacctcctctcttgtttctgtgacctcagtacccacccctacactggcgaagatcacagacatggacacaaacttagaacctgtgactcgttcacctcaaaatttaaggaacaccttggccacttcagaagccaccacagatacacacacaatgcatccttctataaacacagcaatggccaatgtggggaccaccagttcaccaaatgaattctattttactgtctcacctgactcagacccatataaagccacatccgcagtagttatcacttccacctcgggggactcaatagtttccacatcaatgcctagatcctctgcgatgaaaaagattgagtctgagacaactttctccctgatatttagactgagggagactagcacctcccagaaaattggctcatcctcagacacaagcacggtctttgacaaagcattcactgctgctactactgaggtctccagaacagaactcacctcctctagcagaacatccatccaaggcactgaaaagcccacaatgtcaccggacacctccacaagatctgtcaccatgctttctacttttgctggcctgacaaaatccgaagaaaggaccattgccacccaaacaggtcctcatagggcgacatcacagggtacccttacctgggacacatcaatcacaacctcacaggcagggacccactcagctatgactcatggattttcacaattagatttgtccactcttacgagtagagttcctgagtacatatcagggacaagcccaccctctgtggaaaaaaccagctcttcctcttcccttctgtctttaccagcaataacctcaccgtcccctgtacctactacattaccagaaagtaggccgtcttctcctgttcatctgacttcactccccacctctggcctagtgaagaccacagatatgctggcatctgtggccagtttacctccaaacttgggcagcacctcacataagataccgactacttcagaagacattaaagatacagagaaaatgtatccttccacaaacatagcagtaaccaatgtggggaccaccacttctgaaaaggaatcttattcgtctgtcccagcctactcagaaccacccaaagtcacctctccaatggttacctctttcaacataagggacaccattgtttccacatccatgcctggctcctctgagattacaaggattgagatggagtcaacattctccgtggctcatgggctgaagggaaccagcacctcccaggaccccatcgtatccacagagaaaagtgctgtccttcacaagttgaccactggtgctactgagacctctaggacagaagttgcctcttctagaagaacatccattccaggccctgatcattccacagagtcaccagacatctccactgaagtgatccccagcctgcctatctcccttggcattacagaatcttcaaatatgaccatcatcactcgaacaggtcctcctcttggctctacatcacagggcacatttaccttggacacaccaactacatcctccagggcaggaacacactcgatggcgactcaggaatttccacactcagaaatgaccactgtcatgaacaaggaccctgagattctatcatggacaatccctccttctatagagaaaaccagcttctcctcttccctgatgccttcaccagccatgacttcacctcctgtttcctcaacattaccaaagaccattcacaccactccttctcctatgacctcactgctcacccctagcctagtgatgaccacagacacattgggcacaagcccagaacctacaaccagttcacctccaaatttgagcagtacctcacatgagatactgacaacagatgaagacaccacagctatagaagccatgcatccttccacaagcacagcagcgactaatgtggaaaccaccagttctggacatgggtcacaatcctctgtcctagctgactcagaaaaaaccaaggccacagctccaatggataccacctccaccatggggcatacaactgtttccacatcaatgtctgtttcctctgagactacaaaaattaagagagagtcaacatattccttgactcctggactgagagagaccagcatttcccaaaatgccagcttttccactgacacaagtattgttctttcagaagtccccactggtactactgctgaggtctccaggacagaagtcacctcctctggtagaacatccatccctggcccttctcagtccacagttttgccagaaatatccacaagaacaatgacaaggctctttgcctcgcccaccatgacagaatcagcagaaatgaccatccccactcaaacaggtccttctgggtctacctcacaggatacccttaccttggacacatccaccacaaagtcccaggcaaagactcattcaactttgactcagagatttccacactcagagatgaccactctcatgagcagaggtcctggagatatgtcatggcaaagctctccctctctggaaaatcccagctctctcccttccctgctgtctttacctgccacaacctcacctcctcccatttcctccacattaccagtgactatctcctcctctcctcttcctgtgacttcacttctcacctctagcccggtaacgaccacagacatgttacacacaagcccagaacttgtaaccagttcacctccaaagctgagccacacttcagatgagagactgaccactggcaaggacaccacaaatacagaagctgtgcatccttccacaaacacagcagcgtccaatgtggagattcccagctctggacatgaatccccttcctctgccttagctgactcagagacatccaaagccacatcaccaatgtttattacctccacccaggaggatacaactgttgccatatcaacccctcacttcttggagactagcagaattcagaaagagtcaatttcctccctgagccctaaattgagggagacaggcagttctgtggagacaagctcagccatagagacaagtgctgtcctttctgaagtgtccgttggtgctactactgagatctccaggacagaagtcacctcctctagcagaacatccatctctggttctgctgagtccacaatgttgccagaaatatccaccacaagaaaaatcattaagttccctacttcccccatcctggcagaatcatcagaaatgaccatcaagacccaaacaagtcctcctgggtctacatcagagagtacctttacattagacacatcaaccactccctccttggtaataacccattcgactatgactcagagattgccacactcagagataaccactcttgtgagtagaggtgctggggatgtgccacggcccagctctctccctgtggaagaaacaagccctccatcttcccagctgtctttatctgccatgatctcaccttctcctgtttcttccacattaccagcaagtagccactcctcttctgcttctgtgacttcacttctcacaccaggccaagtgaagactactgaggtgttggacgcaagtgcagaacctgaaaccagttcacctccaagtttgagcagcacctcagttgaaatactggccacctctgaagtcaccacagatacggagaaaattcatcctttctcaaacacggcagtaaccaaagttggaacttccagttctggacatgaatccccttcctctgtcctacctgactcagagacaaccaaagccacatcggcaatgggtaccatctccattatgggggatacaagtgtttctacattaactcctgccttatctaacactaggaaaattcagtcagagccagcttcctcactgaccaccagattgagggagaccagcacctctgaagagaccagcttagccacagaagcaaacactgttctttctaaagtgtccactggtgctactactgaggtctccaggacagaagccatctcctttagcagaacatccatgtcaggccctgagcagtccacaatgtcacaagacatctccataggaaccatccccaggatttctgcctcctctgtcctgacagaatctgcaaaaatgaccatcacaacccaaacaggtccttcggagtctacactagaaagtacccttaatttgaacacagcaaccacaccctcttgggtggaaacccactctatagtaattcagggatttccacacccagagatgaccacttccatgggcagaggtcctggaggtgtgtcatggcctagccctccctttgtgaaagaaaccagccctccatcctccccgctgtctttacctgccgtgacctcacctcatcctgtttccaccacattcctagcacatatccccccctctccccttcctgtgacttcacttctcacctctggcccggcgacaaccacagatatcttgggtacaagcacagaacctggaaccagttcatcttcaagtttgagcaccacctcccatgagagactgaccacttacaaagacactgcacatacagaagccgtgcatccttccacaaacacaggagggaccaatgtggcaaccaccagctctggatataaatcacagtcctctgtcctagctgactcatctccaatgtgtaccacctccaccatgggggatacaagtgttctcacatcaactcctgccttccttgagactaggaggattcagacagagctagcttcctccctgacccctggattgagggagtccagtggctctgaagggaccagctcaggcaccaagatgagcactgtcctctctaaagtgcccactggtgctactactgagatctccaaggaagacgtcacctccatcccaggtcccgctcaatccacaatatcaccagacatctccacaagaaccgtcagctggttctctacatcccctgtcatgacagaatcagcagaaataaccatgaacacccatacaagtcctttaggggccacaacacaaggcaccagtactttggccacgtcaagcacaacctctttgacaatgacacactcaactatatctcaaggattttcacactcacagatgagcactcttatgaggaggggtcctgaggatgtatcatggatgagccctccccttctggaaaaaactagaccttccttttctctgatgtcttcaccagccacaacttcaccttctcctgtttcctccacattaccagagagcatctcttcctctcctcttcctgtgacttcactcctcacgtctggcttggcaaaaactacagatatgttgcacaaaagctcagaacctgtaaccaactcacctgcaaatttgagcagcacctcagttgaaatactggccacctctgaagtcaccacagatacagagaaaactcatccttcttcaaacagaacagtgaccgatgtggggacctccagttctggacatgaatccacttcctttgtcctagctgactcacagacatccaaagtcacatctccaatggttattacctccaccatggaggatacgagtgtctccacatcaactcctggcttttttgagactagcagaattcagacagaaccaacatcctccctgacccttggactgagaaagaccagcagctctgaggggaccagcttagccacagagatgagcactgtcctttctggagtgcccactggtgccactgctgaagtctccaggacagaagtcacctcctctagcagaacatccatctcaggctttgctcagctcacagtgtcaccagagacttccacagaaaccatcaccagactccctacctccagcataatgacagaatcagcagaaatgatgatcaagacacaaacagatcctcctgggtctacaccagagagtactcatactgtggacatatcaacaacacccaactgggtagaaacccactcgactgtgactcagagattttcacactcagagatgaccactcttgtgagcagaagccctggtgatatgttatggcctagtcaatcctctgtggaagaaaccagctctgcctcttccctgctgtctctgcctgccacgacctcaccttctcctgtttcctctacattagtagaggatttcccttccgcttctcttcctgtgacttctcttctcacccctggcctggtgataaccacagacaggatgggcataagcagagaacctggaaccagttccacttcaaatttgagcagcacctcccatgagagactgaccactttggaagacactgtagatacagaagacatgcagccttccacacacacagcagtgaccaacgtgaggacctccatttctggacatgaatcacaatcttctgtcctatctgactcagagacacccaaagccacatctccaatgggtaccacctacaccatgggggaaacgagtgtttccatatccacttctgacttctttgagaccagcagaattcagatagaaccaacatcctccctgacttctggattgagggagaccagcagctctgagaggatcagctcagccacagagggaagcactgtcctttctgaagtgcccagtggtgctaccactgaggtctccaggacagaagtgatatcctctaggggaacatccatgtcagggcctgatcagttcaccatatcaccagacatctctactgaagcgatcaccaggctttctacttcccccattatgacagaatcagcagaaagtgccatcactattgagacaggttctcctggggctacatcagagggtaccctcaccttggacacctcaacaacaaccttttggtcagggacccactcaactgcatctccaggattttcacactcagagatgaccactcttatgagtagaactcctggagatgtgccatggccgagccttccctctgtggaagaagccagctctgtctcttcctcactgtcttcacctgccatgacctcaacttcttttttctccacattaccagagagcatctcctcctctcctcatcctgtgactgcacttctcacccttggcccagtgaagaccacagacatgttgcgcacaagctcagaacctgaaaccagttcacctccaaatttgagcagcacctcagctgaaatattagccacgtctgaagtcaccaaagatagagagaaaattcatccctcctcaaacacacctgtagtcaatgtagggactgtgatttataaacatctatccccttcctctgttttggctgacttagtgacaacaaaacccacatctccaatggctaccacctccactctggggaatacaagtgtttccacatcaactcctgccttcccagaaactatgatgacacagccaacttcctccctgacttctggattaagggagatcagtacctctcaagagaccagctcagcaacagagagaagtgcttctctttctggaatgcccactggtgctactactaaggtctccagaacagaagccctctccttaggcagaacatccaccccaggtcctgctcaatccacaatatcaccagaaatctccacggaaaccatcactagaatttctactcccctcaccacgacaggatcagcagaaatgaccatcacccccaaaacaggtcattctggggcatcctcacaaggtacctttaccttggacacatcaagcagagcctcctggccaggaactcactcagctgcaactcacagatctccacactcagggatgaccactcctatgagcagaggtcctgaggatgtgtcatggccaagccgcccatcagtggaaaaaactagccctccatcttccctggtgtctttatctgcagtaacctcaccttcgccactttattccacaccatctgagagtagccactcatctcctctccgggtgacttctcttttcacccctgtcatgatgaagaccacagacatgttggacacaagcttggaacctgtgaccacttcacctcccagtatgaatatcacctcagatgagagtctggccacttctaaagccaccatggagacagaggcaattcagctttcagaaaacacagctgtgactcagatgggcaccatcagcgctagacaagaattctattcctcttatccaggcctcccagagccatccaaagtgacatctccagtggtcacctcttccaccataaaagacattgtttctacaaccatacctgcttcctctgagataacaagaattgagatggagtcaacatccaccctgacccccacaccaagggagaccagcacctcccaggagatccactcagccacaaagccaagcactgttccttacaaggcactcactagtgccacgattgaggactccatgacacaagtcatgtcctctagcagaggacctagccctgatcagtccacaatgtcacaagacatatccagtgaagtgatcaccaggctctctacctcccccatcaaggcagaatctacagaaatgaccattaccacccaaacaggttctcctggggctacatcaaggggtacccttaccttggacacttcaacaacttttatgtcagggacccactcaactgcatctcaaggattttcacactcacagatgaccgctcttatgagtagaactcctggagatgtgccatggctaagccatccctctgtggaagaagccagctctgcctctttctcactgtcttcacctgtcatgacctcatcttctcccgtttcttccacattaccagacagcatccactcttcttcgcttcctgtgacatcacttctcacctcagggctggtgaagaccacagagctgttgggcacaagctcagaacctgaaaccagttcacccccaaatttgagcagcacctcagctgaaatactggccaccactgaagtcactacagatacagagaaactggagatgaccaatgtggtaacctcaggttatacacatgaatctccttcctctgtcctagctgactcagtgacaacaaaggccacatcttcaatgggtatcacctaccccacaggagatacaaatgttctcacatcaacccctgccttctctgacaccagtaggattcaaacaaagtcaaagctctcactgactcctgggttgatggagaccagcatctctgaagagaccagctctgccacagaaaaaagcactgtcctttctagtgtgcccactggtgctactactgaggtctccaggacagaagccatctcttctagcagaacatccatcccaggccctgctcaatccacaatgtcatcagacacctccatggaaaccatcactagaatttctacccccctcacaaggaaagaatcaacagacatggccatcacccccaaaacaggtccttctggggctacctcgcagggtacctttaccttggactcatcaagcacagcctcctggccaggaactcactcagctacaactcagagatttccacagtcagtggtgacaactcctatgagcagaggtcctgaggatgtgtcatggccaagcccgctgtctgtggaaaaaaacagccctccatcttccctggtatcttcatcttcagtaacctcaccttcgccactttattccacaccatctgggagtagccactcctctcctgtccctgtcacttctcttttcacctctatcatgatgaaggccacagacatgttggatgcaagtttggaacctgagaccacttcagctcccaatatgaatatcacctcagatgagagtctggccgcttctaaagccaccacggagacagaggcaattcacgtttttgaaaatacagcagcgtcccatgtggaaaccaccagtgctacagaggaactctattcctcttccccaggcttctcagagccaacaaaagtgatatctccagtggtcacctcttcctctataagagacaacatggtttccacaacaatgcctggctcctctggcattacaaggattgagatagagtcaatgtcatctctgacccctggactgagggagaccagaacctcccaggacatcacctcatccacagagacaagcactgtcctttacaagatgccctctggtgccactcctgaggtctccaggacagaagttatgccctctagcagaacatccattcctggccctgctcagtccacaatgtcactagacatctccgatgaagttgtcaccaggctgtctacctctcccatcatgacagaatctgcagaaataaccatcaccacccaaacaggttattctctggctacatcccaggttacccttcccttgggcacctcaatgacctttttgtcagggacccactcaactatgtctcaaggactttcacactcagagatgaccaatcttatgagcaggggtcctgaaagtctgtcatggacgagccctcgctttgtggaaacaactagatcttcctcttctctgacatcattacctctcacgacctcactttctcctgtgtcctccacattactagacagtagcccctcctctcctcttcctgtgacttcacttatcctcccaggcctggtgaagactacagaagtgttggatacaagctcagagcctaaaaccagttcatctccaaatttgagcagcacctcagttgaaataccggccacctctgaaatcatgacagatacagagaaaattcatccttcctcaaacacagcggtggccaaagtgaggacctccagttctgttcatgaatctcattcctctgtcctagctgactcagaaacaaccataaccataccttcaatgggtatcacctccgctgtggacgataccactgttttcacatcaaatcctgccttctctgagactaggaggattccgacagagccaacattctcattgactcctggattcagggagactagcacctctgaagagaccacctcaatcacagaaacaagtgcagtcctttatggagtgcccactagtgctactactgaagtctccatgacagaaatcatgtcctctaatagaacacacatccctgactctgatcagtccacgatgtctccagacatcatcactgaagtgatcaccaggctctcttcctcatccatgatgtcagaatcaacacaaatgaccatcaccacccaaaaaagttctcctggggctacagcacagagtactcttaccttggccacaacaacagcccccttggcaaggacccactcaactgttcctcctagatttttacactcagagatgacaactcttatgagtaggagtcctgaaaatccatcatggaagagctctccctttgtggaaaaaactagctcttcatcttctctgttgtccttacctgtcacgacctcaccttctgtttcttccacattaccgcagagtatcccttcctcctctttttctgtgacttcactcctcaccccaggcatggtgaagactacagacacaagcacagaacctggaaccagtttatctccaaatctgagtggcacctcagttgaaatactggctgcctctgaagtcaccacagatacagagaaaattcatccttcttcaagcatggcagtgaccaatgtgggaaccaccagttctggacatgaactatattcctctgtttcaatccactcggagccatccaaggctacatacccagtgggtactccctcttccatggctgaaacctctatttccacatcaatgcctgctaattttgagaccacaggatttgaggctgagccattttctcatttgacttctggatttaggaagacaaacatgtccctggacaccagctcagtcacaccaacaaatacaccttcttctcctgggtccactcaccttttacagagttccaagactgatttcacctcttctgcaaaaacatcatccccagactggcctccagcctcacagtatactgaaattccagtggacataatcaccccctttaatgcttctccatctattacggagtccactgggataacctccttcccagaatccaggtttactatgtctgtaacagaaagtactcatcatctgagtacagatttgctgccttcagctgagactatttccactggcacagtgatgccttctctatcagaggccatgacttcatttgccaccactggagttccacgagccatctcaggttcaggtagtccattctctaggacagagtcaggccctggggatgctactctgtccaccattgcagagagcctgccttcatccactcctgtgccattctcctcttcaaccttcactaccactgattcttcaaccatcccagccctccatgagataacttcctcttcagctaccccatatagagtggacaccagtcttgggacagagagcagcactactgaaggacgcttggttatggtcagtactttggacacttcaagccaaccaggcaggacatcttcaacacccattttggataccagaatgacagagagcgttgagctgggaacagtgacaagtgcttatcaagttccttcactctcaacacggttgacaagaactgatggcatt

SEQ ID NO: 310 - protein, 10431 aa, Homo sapiens
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTDTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWTSVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGTSPAGTSPGSPEMSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLKDPEYAGHKLGIWDDFIPKFGKAAHMRELPLLSPPQDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFTYSEKTTLFSKGPEDTSQPSPPSVEETSSSSSLVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVTWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKSHILPMLPPPPWKTPQFPRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVNSSSKISTPDHDKSTVPPDTFTGEIPRVFTSSIKTKSAEMTITTQASPPESASHSTLPLDTSTTLSQGGTHSTVTQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTTSTLGDTSVSTSTPNISQTNQIQTEPTASLSPRLRESSTSEKTSSTTETNTAFSYVPTGAITQASRTEISSSRTSISDLDRPTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPETVTSSPPNLSSPTQERLTTYKDTAHTEAMHASMHTNTAVANVGTSISGHESQSSVPADSHTSKATSPMGITFAMGDTSVSTSTPAFFETRIQTESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAMANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSVAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHEILTTDEDTTAIEAMHPSTSTAATNVETTSSGHGSQSSVLADSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSSGHESPSSALADSETSKATSPMFITSTQEDTTVAISTPHFLETSRIQKESISSLSPKLRETGSSVETSSAIETSAVLSEVSVGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSLLTPGQVKTTEVLDASAEPETSSPPSLSSTSVEILATSEVTTDTEKIHPFSNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDISTRTVSWFSTSPVMTESAEITMNTHTSPLGATTQGTSTLATSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLTPGLVITTDRMGISREPGTSSTSNLSSTSHERLTTLEDTVDTEDMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSTLPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISSEVITRLSTSPIKAESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILATTEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLAASKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMPSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRTHIPDSDQSTMSPDIITEVITRLSSSSMMSESTQMTITTQKSSPGATAQSTLTLATTTAPLARTHSTVPPRFLHSEMTTLMSRSPENPSWKSSPFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSTPILDTRMTESVELGTVTSAYQVPSLSTRLTRTDGI

SEQ ID NO: 311 - DNA, 57082 bp, Homo sapiens
  misc_feature (2205)..(11679): Exon 1
  misc_feature (13464)..(13570): Exon 2
  misc_feature (16177)..(34419): Exon 3
  misc_feature (34420)..(34534): n is a, c, g, or t
  misc_feature (34575)..(38024): Exon 4
  misc_feature (38689)..(38800): Exon 5
  misc_feature (39715)..(39771): n is a, c, g, or t
  misc_feature (40578)..(45257): Exon 6
  misc_feature (47360)..(47395): Exon 7
  misc_feature (52407)..(52442): Exon 8
  misc_feature (52686)..(52744): Exon 9
ggtgcgcaccactatgtctggctaatttttgtatttttttgtagagacatggtttcaccatgttggccaggctggtctcgaattcctgacttcaagtaatccacccacctcagcctcccaaagtgctgggattacaagcatgagccaccatgcatggcctaaagcttcttttaaagccaccaagtcccttcccatgttagcccactaatccatgggttagtcatgaatggattaatctattcatacggacagagccctcatcacccaatcacctcttaaaggccccacctctcaatactgccacactggggattaagtttcaacagagttttggaggggacattcaaatcatagtaatgcccaaagtgaaaaatcttccctgcacttttccctcaacaaaaacagccagagatagtgagctgccaggaaattcttttttttttcctcttctgtcctaaatcagcatcgctagacctttacatgattcaacctcatcttcttcaccctctgggtcatgaaattttatttatttatttattattttcttgggacagactctggctctgtcgcccaggctgaagtgcagtggtgtgatcttggctcactgcaacctccgcctcccgggttcaagcgattctcctgcctcagcctcctgagtagctgggattacaggtgggcgccaccacacccagctaattttttgtatttttagtagagatggggtttcaccatattagccaggatggtctccatctcttgacctcgtgatctgcccacctcagcctcccaaaatgctgggattacaggcatgagacaccacgcccagcaggccagggtcatgagattttaatcaagagcaacttccactgattcctgagagtgcatctgtgggcccctgctctgatctgaacagaagtgccgtgtcttctctgacctccacttctcaattcaagagccttagtatctgccagtatcacacactgagcattagctccatctcatgggggtgtaggtaggggctctatctgcatctttctttctttttttctttctttcccttcctcccttcctcactccctcggtcctctctttctttccttttctttcttccttcctcccttcctccctccctccctctctctttctctctttctttctttccttctttctttctttctctcttccttccctccctccctccttccttcctttctctttctttctctttctttctttttttccttccttccttccttctttctctttctctccctcccttccttccttccttccttccttccttcctttctttctttctttctttctttctttctttctttctttctttctttctttcttccttccttccttccttccttccttccttccttccttcctttcttttctttctttctctttctttttgagacagagctcttattacccatgctggagtgcagtggtgtgaccttggcttactgcaacatctgcctcctagggtcaagtgattctcctgcctcagcctcctaagtagctgggattacagacacatgccaccacacccaatatttatttttattaaaattttttttaaaattatttttaaaaaattaaaaataattttgtatttttagtagagacggggtttctccatgttggtcaggctgatctcaaactcccaacctcaggtgatcctcccacctcacctcccaaagtgctgggattacaggcatgagccaccgtgcccagcctggttcctggtttctaagacatcacacacacacacacacacacacacacacactcacacactcagagagagagagagagagaggatcattaagacatgatacactaagaaattctattctgcagacactgagaatccgttaaaaagtttgaagggaagaattgagatcatcaggtgtttatttgaggaaattgtctgtggttgaactatcctttcctttctctccctgagatttggtcttctcaattagaagcgttgcacaattcccccaacctccatacatacggcagctcttctagacacaggttttcccaggtcaaatgcggggaccccagccatatctcccaccctgagaaattttggagtttcagggagctcagaagctctgcagaggccaccctctctgaggggattcttcttagacctccatccagaggcaaatgttgacctgtccatgctgaaaccctcaggccttcctgggtcatcttctcccacccgctccttgatgacagggagcaggagcactaaagccacaccagaaatggattcaggactgacaggagccaccttgtcacctaagacatctacaggtgcaatcgtggtgacagaacatactctgccctttacttccccagataagaccttggccagtcctacatcttcggttgtgggaagaaccacccagtctttgggggtgatgtcctctgctctccctgagtcaacctctagaggaatgacacactccgagcaaagaaccagcccatcgctgagtccccaggtcaatggaactccctctaggaactaccctgctacaagcatggtttcaggattgagttccccaaggaccaggaccagttccacagaaggaaattttaccaaagaagcatctacatacacactcactgtagagaccacaagtggcccagtcactgagaagtacacagtccccactgagacctcaacaactgaaggtgacagcacagagaccccctgggacacaagatatattcctgtaaaaatcacatctccaatgaaaacatttgcagattcaactgcatccaaggaaaatgccccagtgtctatgactccagctgagaccacagttactgactcacatactccaggaaggacaaacccatcatttgggacactttattcttccttccttgacctatcacctaaagggaccccaaattccagaggtgaaacaagcctggaactgattctatcaaccactggatatcccttctcctctcctgaacctggctctgcaggacacagcagaataagtaccagtgcgcctttgtcatcatctgcttcagttctcgataataaaatatcagagaccagcatattctcaggccagagtctcacctcccctctgtctcctggggtgcccgaggccagagccagcacaatgcccaactcagctatccctttttccatgacactaagcaatgcagaaacaagtgccgaaagggtcagaagcacaatttcctctctggggactccatcaatatccacaaagcagacagcagagactatccttaccttccatgccttcgctgagaccatggatatacccagcacccacatagccaagactttggcttcagaatggttgggaagtccaggtacccttggtggcaccagcacttcagcgctgacaaccacatctccatctaccactttagtctcagaggagaccaacacccatcactccacgagtggaaaggaaacagaaggaactttgaatacatctatgactccacttgagacctctgctcctggagaagagtccgaaatgactgccaccttggtccccactctaggttttacaactcttgacagcaagatcagaagtccatctcaggtctcttcatcccacccaacaagagagctcagaaccacaggcagcacctctgggaggcagagttccagcacagctgcccacgggagctctgacatcctgagggcaaccacttccagcacctcaaaagcatcatcatggaccagtgaaagcacagctcagcaatttagtgaaccccagcacacacagtgggtggagacaagtcctagcatgaaaacagagagacccccagcatcaaccagtgtggcagcccctatcaccacttctgttccctcagtggtctctggcttcaccaccctgaagaccagctccacaaaagggatttggcttgaagaaacatctgcagacacactcatcggagaatccacagctggcccaaccacccatcagtttgctgttcccactgggatttcaatgacaggaggcagcagcaccaggggaagccagggcacaacccacctactcaccagagccacagcatcatctgagacatccgcagatttgactctggccacgaacggtgtcccagtctccgtgtctccagcagtgagcaagacggctgctggctcaagtcctccaggagggacaaagccatcatatacaatggtttcttctgtcatccctgagacatcatctctacagtcctcagctttcagggaaggaaccagcctgggactgactccattaaacactagacatcccttctcttcccctgaaccagactctgcaggacacaccaagataagcaccagcattcctctgttgtcatctgcttcagttcttgaggataaagtgtcagcgaccagcacattctcacaccacaaagccacctcatctattaccacagggactcctgaaatctcaacaaagacaaagcccagctcagccgttctttcctccatgaccctaagcaatgcagcaacaagtcctgaaagagtcagaaatgcaacttcccctctgactcatccatctccatcaggggaagagacagcagggagtgtcctcactctcagcacctctgctgagactacagactcacctaacatccacccaactgggacactgacttcagaatcgtcagagagtcctagcactctcagcctcccaagtgtctctggagtcaaaaccacattttcttcatctactccttccactcatctatttactagtggagaagaaacagaggaaacttcgaatccatctgtgtctcaacctgagacttctgtttccagagtaaggaccaccttggccagcacctctgtccctaccccagtattccccaccatggacacctggcctacacgttcagctcagttctcttcatcccacctagtgagtgagctcagagctacgagcagtacctcagttacaaactcaactggttcagctcttcctaaaatatctcacctcactgggacggcaacaatgtcacagaccaatagagacacgtttaatgactctgctgcaccccaaagcacaacttggccagagactagtcccagattcaagacagggttaccttcagcaacaaccactgtttcaacctctgccacttctctctctgctactgtaatggtctctaaattcacttctccagcaactagttccatggaagcaacttctatcagggaaccatcaacaaccatcctcacaacagagaccacgaatggcccaggctctatggctgtggcttctaccaacatcccaattggaaagggctacattactgaaggaagattggacacaagccatctgcccattggaaccacagcttcctctgagacatctatggattttaccatggccaaagaaagtgtctcaatgtcagtatctccatctcagtccatggatgctgctggctcaagcactccaggaaggacaagccaattcgttgacacattttctgatgatgtctatcatttaacatccagagaaattacaatacctagagatggaacaagctcagctctgactccacaaatgactgcaactcaccctccatctcctgatcctggctctgctagaagcacctggcttggcatcttgtcctcatctccttcttctcctactcccaaagtcacaatgagctccacattttcaactcagagagtcaccacaagcatgataatggacacagttgaaactagtcggtggaacatgcccaacttaccttccacgacttccttgacaccaagtaatattccaacaagtggtgccataggaaaaagcaccctggttcccttggacactccatctccagccacatcattggaggcatcagaagggggacttccaaccctcagcacctaccctgaatcaacaaacacacccagcatccacctcggagcacacgctagttcagaaagtccaagcaccatcaaacttaccatggcttcagtagtaaaacctggctcttacacacctctcaccttcccctcaatagagacccacattcatgtatcaacagccagaatggcttactcttctgggtcttcacctgagatgacagctcctggagagactaacactggtagtacctgggaccccaccacctacatcaccactacggatcctaaggatacaagttcagctcaggtctctacaccccactcagtgaggacactcagaaccacagaaaaccatccaaagacagagtccgccaccccagctgcttactctggaagtcctaaaatctcaagttcacccaatctcaccagtccggccacaaaagcatggaccatcacagacacaactgaacactccactcaattacattacacaaaattggcagaaaaatcatctggatttgagacacagtcagctccaggacctgtctctgtagtaatccctacctcccctaccattggaagcagcacattggaactaacttctgatgtcccaggggaacccctggtccttgctcccagtgagcagaccacaatcactctccccatggcaacatggctgagtaccagtttgacagaggaaatggcttcaacagaccttgatatttcaagtccaagttcacccatgagtacatttgctatttttccacctatgtccacaccttctcatgaactttcaaagtcagaggcagataccagtgccattagaaatacagattcaacaacgttggatcagcacctaggaatcaggagtttgggcagaactggggacttaacaactgttcctatcaccccactgacaaccacgtggaccagtgtgattgaacactcaacacaagcacaggacaccctttctgcaacgatgagtcctactcacgtgacacagtcactcaaagatcaaacatctataccagcctcagcatccccttcccatcttactgaagtctaccctgagctcgggacacaagggagaagctcctctgaggcaaccactttttggaaaccatctacagacacactgtccagagagattgagactggcccaacaaacattcaatccactccacccatggacaacacaacaacagggagcagtagtagtggagtcaccctgggcatagcccaccttcccataggaacatcctccccagctgagacatccacaaacatggcactggaaagaagaagttctacagccactgtctctatggctgggacaatgggactccttgttactagtgctccaggaagaagcatcagccagtcattaggaagagtttcctctgtcctttctgagtcaactactgaaggagtcacagattctagtaagggaagcagcccaaggctgaacacacagggaaatacagctctctcctcctctcttgaacccagctatgctgaaggaagccagatgagcacaagcatccctctaacctcatctcctacaactcctgatgtggaattcatagggggcagcacattttggaccaaggaggtcaccacagttatgacctcagacatctccaagtcttcagcaaggacagagtccagctcagctacccttatgtccacagctttgggaagcactgaaaatacaggaaaagaaaaactcagaactgcctctatggatcttccatctccaactccatcaatggaggtgacaccatggatttctctcactctcagtaatgcccccaataccacagattcacttgacctcagccatggggtgcacaccagctctgcagggactttggccactgacaggtcattgaatactggtgtcactagagcctccagattggaaaacggctctgatacctcttctaagtccctgtctatgggaaacagcactcacacttccatgacttacacagagaagagtgaagtgtcttcttcaatccatccccgacctgagacctcagctcctggagcagagaccactttgacttccactcctggaaacagggccataagcttaacattgcctttttcatccattccagtggaagaagtcatttctacaggcataacctcaggaccagacatcaactcagcacccatgacacattctcccatcaccccaccaacaattgtatggaccagtacaggcacaattgaacagtccactcaaccactacatgcagtttcttcagaaaaagtttctgtgcagacacagtcaactccatatgtcaactctgtggcagtgtctgcttcccctacccatgagaattcagtctcttctggaagcagcacatcctctccatattcctcagcctcacttgaatccttggattccacaatcagtaggaggaatgcaatcacttcctggctatgggacctcactacatctctccccactacaacttggccaagtactagtttatctgaggcactgtcctcaggccattctggggtttcaaacccaagttcaactacgactgaatttccactcttttcagctgcatccacatctgctgctaagcaaagaaatccagaaacagagacccatggtccccagaatacagccgcgagtactttgaacactgatgcatcctcggtcacaggtctttctgagactcctgtgggggcaagtatcagctctgaagtccctcttccaatggccataacttctagatcagatgtttctggccttacatctgagagtactgctaacccgagtttaggcacagcctcttcagcagggaccaaattaactaggacaatatccctgcccacttcagagtctttggtttcctttagaatgaacaaggatccatggacagtgtcaatccctttggggtcccatccaactactaatacagaaacaagcatcccagtaaacagcgcaggtccacctggcttgtccacagtagcatcagatgtaattgacacaccttcagatggggctgagagtattcccactgtctccttttccccctcccctgatactgaagtgacaactatctcacatttcccagaaaagacaactcattcatttagaaccatttcatctctcactcatgagttgacttcaagagtgacacctattcctggggattggatgagttcagctatgtctacaaagcccacaggagccagtccctccattacactgggagagagaaggacaatcacctctgctgctccaaccacttcccccatagttctcactgctagtttcacagagaccagcacagtttcactggataatgaaactacagtaaaaacctcagatatccttgacgcacggaaaacaaatgagctcccctcagatagcagttcttcttctgatctgatcaacacctccatagcttcttcaactatggatgtcactaaaacagcctccatcagtcccactagcatctcaggaatgacagcaagttcctccccatctctcttctcttcagatagaccccaggttcccacatctacaacagagacaaatacagccacctctccatctgtttccagtaacacctattctcttgatgggggctccaatgtgggtggcactccatccactttaccaccctttacaatcacccaccctgtcgagacaagctcggccctattagcctggtctagaccagtaagaactttcagcaccatggtcagcactgacactgcctccggagaaaatcctacctctagcaattctgtggtgacttctgttccagcaccaggtacatggaccagtgtaggcagtactactgacttacctgccatgggctttctcaagacaagtcctgcaggagaggcacactcacttctagcatcaactattgaaccagccactgccttcactccccatctctcagcagcagtggtcactggatccagtgctacatcagaagccagtcttctcactacgagtgaaagcaaagccattcattcttcaccacagaccccaactacacccacctctggagcaaactgggaaacttcagctactcctgagagccttttggtagtcactgagacttcagacacaacacttacctcaaagattttggtcacagataccatcttgttttcaactgtgtccacgccaccttctaaatttccaagtacggggactctgtctggagcttccttccctactttactcccggacactccagccatccctctcactgccactgagccaacaagttcattagctacatcctttgattccaccccactggtgactatagcttcggatagtcttggcacagtcccagagactaccctgaccatgtcagagacctcaaatggtgatgcactggttcttaagacagtaagtaacccagataggagcatccctggaatcactatccaaggagtaacagaaagtccactccatccttcttccacttccccctctaagattgttgctccacggaatacaacctatgaaggttcgatcacagtggcactttctactttgcctgcgggaactactggttcccttgtattcagtcagagttctgaaaactcagagacaacggctttggtagactcatcagctgggcttgagagggcatctgtgatgccactaaccacaggaagccagggtatggctagctctggaggaatcagaagtgggtccactcactcaactggaaccaaaacattttcttctctccctctgaccatgaacccaggtgaggttacagccatgtctgaaatcaccacgaacagactgacagctactcaatcaacagcacccaaagggatacctgtgaagcccaccagtgctgagtcaggcctcctaacacctgtctctgcctcctcaagcccatcaaaggcctttgcctcactgactacagctcccccaacttgggggatcccacagtctaccttgacatttgagttttctgaggtcccaagtttggatactaagtccgcttctttaccaactcctggacagtccctgaacaccattccagactcagatgcaagcacagcatcttcctcactgtccaagtctccagaaaaaaacccaagggcaaggatgatgacttccacaaaggccataagtgcaagctcatttcaatcaacaggttttactgaaacccctgagggatctgcctccccttctatggcagggcatgaacccagagtccccacttcaggaacaggggaccctagatatgcctcagagagcatgtcttatccagacccaagcaaggcatcatcagctatgacatcgacctctcttgcatcaaaactcacaactctcttcagcacaggtcaagcagcaaggtctggttctagttcctctcccataagcctatccactgagaaagaaacaagcttcctttcccccactgcatccacctccagaaagacttcactatttcttgggccttccatggcaaggcagcccaacatattggtgcatcttcagacttcagctctgacactttctccaacatccactctaaatatgtcccaggaggagcctcctgagttaacctcaagccagaccattgcagaagaagagggaacaacagctgaaacacagacgttaaccttcacaccatctgagaccccaacatccttgttacctgtctcttctcccacagaacccacagccagaagaaagagttctccagaaacatgggcaagctctatttcagttcctgccaagacctccttggttgaaagtaagaatgccctgctccttccccaagtgtgctggggatgaatctggaaataaactacatcttttttattttttaaacttttatatttgaaaatataaatattttaggttcagggaacatgtgcaggtttgttatataggtaaattgcatgtcatgggggcttggggtacagattacatcatcagccaggtaataagcctagtacctgatcagtagattttttttaatcctctccctcctcccagcctccaccctcaattcacatgtctccatgtgtactcaaggtttaattcccacttatgagtgagaacatgcggtatttgtaaactacatctttatttttgctaacctcgaactgaaatttagcatttgttttattgatgaatagaggtaacaaaacaaaccacattaatcctagcagtgcctgtgcctttgccaacaacagaaattccggacactttcatatcctatgacaattgttgcaagcacttttaaaaatcatgtacgactttattcataattatagtggttattaggcttttcaatagatcttatttaatgagttagtaaaataagtgcctgtattattgtattacatttgtttattaagatcttgataacaacatttcaatataatcatttcctttgttttttaaattttagattcaggggtatatgtgcaggtttgttacgtggatatactgcataatgatgaggtttggcttctagtgaacccatcagccaaatagtgaatgttgtgcccaataagtagtttttcaatcctcacttcactcccagcctcctctattttggagtcccagtgtctattatttctatctttatgtccacatgtacccattggttagctcccacttataagtgagaatgtgcagtatttaattttctgtttttgagttattttgcttaggttgatggccttcagctccagccacgttgctttaaagaacatgatttcattcttttttatggctgcatagtactccgaggtgtatgtgtaccagattttctttatccacaatgatttcctttgtaatctaatattttatattgttattttatgttttattctatatttttattttaatttataaaggaattcatatggttcacaagcctgtcaaagggacctataataaaaagaggttaagaatccatgctctaaacagaatattactccattttatttcatttatttttaaagagacagtctcactctgtcatccaggctggagtacagtggagtgatcatagctcattgcaaccctgaactcttgggcacaagcaattctcctgcttcatcctccagaggagctgggactacaggtgcacatcaccatgcccagctagttttaaaaattattttgtagagatggtgtctcactatcctacccaggctggtctcaaactcctgggctcaggcaatcctcccactttgacctcccaaagtgttgagattacaggggcaagccactgtgcctggccacttgtcacattttaatttgtgattacttataaaatgaaccccttcccatctgagatctgtcagtctttctggtgacggtgcctggtgtctgctttctaccatgtcctgttagactagtgtttgatgggaggtcacctgggcagctgtccagctcactcactgggctctagagcctctgagttgaagcaaaatagaaagatcagtcaatgtaaagaaagctcaaaaactgacattctgaagtaatggatagctaaaccttcctattgcccttttctttcagcaactgatggaacgctagtgaccaccataaagatgtcaagccaggcagcacaaggaaattccacgtggcctgccccagcagaggagacggggaccagtccagcaggtaaatatagaccttgtttccatttctgctctgctaatgccacccaagcctttcttttcttttcttttcttttcttttcttttcttttcttttcttttctttctctccctttctttctttctttctttctttctttctttctttctttctttctttctttctctttctttctttctttctttctttctttctttctttctttctttctttctctttctttcttctttctctctctctctttctttctttctcttgttctttttaaattttttatttttttacttaatttttttcacccaagccttaaggccagtttggaccagatagtgagaccccacctctataaaaaaaatttttaaaaaaaaaataagttgggcatcgtgcaggcctgtagtccctgctactcgagaggccaaggtgggaggacagcttgctgctgactaaaagtgctgcttattgattctgggaagaaaaaatatacaaggcttcagtttcattattttataagtaaatgctagcaacttttcctttctttctctctttctctcttcctctctttctctcctctccttctcttctctctctctctctctctctctctctttctctctcctctccttctcttctcttctttctctctctctctctttcatttatttttgagacatggtctcattctgtcacccaggctggagtacagtggtgtatatttactgcagtactcactgtactcactgcagcctcaaattcctgggctcaagctatcctctcacctcagcctcctgagtagctgggcagcagtccagctcactcactgggctctagagcctctgtgctatgcccagcttattgttgttgtttttttaaatttttttttttgtacagatggggtctcactatgtggcccaaggtggtcttaaactcctggctccaagagatcctcccacctcagcctcccaaagtgcagggattacaggtgtgagccactgtgcccagcctagacagcattttttttttttgaaacagggtctccctctgttgcccaggctggagtgcaatggcgtgttcatggttcactgcagcctcagcctcctcagtctcaagcaatcctccaacttcagcctcccccaacagctagaactgcaggtgatcatcaccaattagcctggttaattgtgtgtgtatttcttaaattttttgtagagatagttctcactatattgcttgggctggtctcaaactcctggactcaagtgattcacctacctcggcctccctaagcactgggattacaggcttgagccaccacacccggcaaggactaggttttaaaataggttcctaggctgggtgtggtggcttacgcccgtaatcccagcactttgggaggctgaggtgggcggatcacgaggtcaggagtttgagaccagcctggccaacatagtgaaaccctgtctctactaaaaatacaaaaaattagctgggcatagtggcacacacctgtaatcccagctactcgggaggctgaggaaggagaatcacttgaacctgggaggcggaggttgcagtgagccgagatcatgccattgctctccagcctgggtgacagagcaagactccatctaaaaaaaaaaaaaaaagttcctttgacttcttgacactcttctctgaggatattgatcatttttccccaatagatgttactaattgaacacttctgttgcttcaacttactaatttacatgatcaatagccaattaattcagcaggagagaatgctacagagtcgattctttctgtactttcttctgctccagagtgaaggatctttctaaatcagagaccatcactgtgttcacagggagggcctaggtgaacctgagatggcaaatgttgcgtttgttctacggaagaagggattatgggttgaagtccttggcagtgccaaattgcttagaaaaatgtgaaatatggtccctaggagtgctcttgggatgtcacatttttctcactcctttgacaggtagatgttattttcctgaaggccagggaaaggattcagagggaggaatgaatttgaaagaaaatgaaggtgacgagaaagaatgagctcatctcccttatcctctttcttctcaaatccttaagtagctttgcagtgaactaagatttgggggaacctagaggaggctgaaagttggaagctgaaattggcttagcaagggcaagctccaaagacaaaagtggaaatagtttgggggtagccttttgcatgggtgaaatcctggttcatcacatcctcccttatgcaaagagcccttttatatggggcatggggaaaaactgagctaaaggtgataatttctcctgagcaagccagatggtcaaagctctaacttcaccatctcccttggaatgtttaatgtgttccctggtgtccagaggcttaacgtgtgagaattaaaagctcaacattttctttcccagggaaggaggaaatagttttaattgaaatcccgggaggaaatgaatgatagtgtcaaaccaaaaaacttcatcttctgtaccacttgcatatactccactgacttactttctaatcacaggcacatccccaggaagcccagaaatgtctaccactctcaaaatcatgagctccaaggaacccggcatcagcccagagatcaggtccactgtgagaaattctccttggaagactccagaaacaactgttcccatggagaccacagtggaaccagtcacccttcagtccacagccctaggaagtggcagcaccagcatctctcacctgcccacaggaaccacatcaccaaccaagtcaccaacagaaaatatgttggctacagaaagggtctccctctccccatccccacctgaggcttggaccaacctttattctggaactccaggagggaccaggcagtcactggccacaatgtcctctgtctccctagagtcaccaactgctagaagcatcacagggactggtcagcaaagcagtccagaactggttttaaagacaactggaatggaattctctatgtggcatggctctactggagggaccacaggggacacacatgtctctctgagcacatcttccaatatccttgaagaccctgtaaccagcccaaactctgtgagctcattgacagataaatccaaacataaaaccgagacatgggtcagcaccacagccattccctccactgtcctgaataataagataatggcagctgaacaacagacaagtcgatctgtggatgaggcttattcatcaactagttcttggtcagatcagacatctgggagtgacatcacccttggtgcatctcctgatgtcacaaacacattatacatcacctccacagcacaaaccacctcactagtatctctgccctctggagaccaaggcattacaagcctcaccaatccctcaggaggaaaaacaagctctgcatcatctgtcacatctccttcaatagggcttgagactctgatggccaatgtaagtgcagtgacaagtgacattgcccctactgctgggcatctatctcagacttcatctcctgcggaagtgagcatcctggacataaccacagctcctactccaggtatctccaccaccatcaccaccatgggaaccaactcaatctcaactaccacacccaacccagaagtgggtatgagtaccatggacagcaccccggccacagagaggcacacaacttctacagaacacccttccacctggtcttccacagctgcatcagattcctggactgtcacagacatgacttcaaacttgaaagttgcaagatctcctggaacaatttccacaatgcatacaacttcattcttagcctcaagcactgaattagactccatgtctactccccatggccgtataactgtcattggaaccagcctggtcactccatcctctgatgcttcagctgtaaagacagagaccagtacaagtgaaagaacattgagtccttcagacacaactgcatctactcccatctcaactttttctcgtgtccagaggatgagcatctcagttcctgacattttaagtacaagttggactcccagtagtacagaagcagaagatgtgcctgtttcaatggtttctacagatcatgctagtacaaagactgacccaaatatgcccctgtccacttttctgtttgattctctgtccactcttgactgggacactgggagatctctgtcatcagccacagccactacctcagctcctcagggggccacaactccccaagaactcactttggaaaccatgatcagcccagctacctcacagttgcccttctctatagggcacattacaagtgcagtcataccagctgcaatggcaaggagctctggagttactttttcaagaccagatcccacaagcaaaaaggcagagcagacttccactcagcttcccaccaccacttctgcacatccagagcaggtgcccagatcagcagcaacaactctggatgtgatcccacacacagcaaaaactccagatgcaacttttcagagacaagggcagacagctcttacaacagaggcaagagctacatctgactcctggaatgagaaagaaaaatcaaccccaagtgcaccttggatcactgagatgatgaattctgtctcagaagataccatcaaggaggttaccagctcctccagtgtgttaaggaccctgaatacgctggacataaacttggaatctgggacgacttcatccccaagttggaaaagcagcccatatgagagaattgccccttctgagtctaccacagacaaagaggcaattcacccttctacaaacacagtagagaccactggctgggtcacaagttccgaacatgcttctcattccactatcccagcccactcagcgtcatccaaactcacatctccagtggttacaacctccaccagggaacaagcaatagtttctatgtcaacaaccacatggccagagtctacaagggctagaacagagcctaattccttcttgactattgaactgagggacgtcagcccttacatggacaccagctcaaccacacaaacaagttttatctcttccccaggttccactgcgatcaccaaggggcctagaacagaaattacctcctctaagagaatatccagctcattccttgcccagtctatgaggtcgtcagacagcccctcagaagccatctccaggctgtctaactttcctgccatgacagaatctggaggaatgatccttgctatgcaaacaagtccacctggcgctacatcactaagtgcacctactttggatacatcagccacagcctcctggacagggactccactggctacgactcagagatttacatactcagagaagaccactctctttagcaaaggtcctgaggatacatcacagccaagccctccctctgtggaagaaaccagctcttcctcttccctggtacctatcaatgctacaacctcgccttccaatattttgttgacatcacaagggcacagtccctcctctactccacctgtgacctcagttttcttgtctgagacctctggcctggggaagaccacagacatgtcgaggataagcttggaacctggcacaagtttacctcccaatttgagcagtacagcaggtgaggcgttatccacttatgaagcctccagagatacaaaggcaattcatcattctgcagacacagcagtgacgaatatggaggcaaccagttctgaatattctcctatcccaggccatacaaagccatccaaagccacatctccattggttacctcccacatcatgggggacatcacttcttccacatcagtatttggctcctccgagaccacagagattgagacagtgtcctctgtgaaccagggacttcaggagagaagcacatcccaggtggccagctctgctacagagacaagcactgtcattacccatgtgtctagtggtgatgctactactcatgtcaccaagacacaagccactttctctagcggaacatccatctcaagccctcatcagtttataacttctaccaacacatttacagatgtgagcaccaacccctccacctctctgataatgacagaatcttcaggagtgaccatcaccacccaaacaggtcctactggagctgcaacacagggtccatatctcttggacacatcaaccatgccttacttgacagagactccattagctgtgactccagattttatgcaatcagagaagaccactctcataagcaaaggtcccaaggatgtgtcctggacaagccctccctctgtggcagaaaccagctatccctcttccctgacacctttcttggtcacaaccatacctcctgccacttccacgttacaagggcaacatacatcctctcctgtttctgcgacttcagttcttacctctggactggtgaagaccacagatatgttgaacacaagcatggaacctgtgaccaattcacctcaaaatttgaacaatccatcaaatgagatactggccactttggcagccaccacagatatagagactattcatccttccataaacaaagcagtgaccaatatggggactgccagttcagcacatgtactgcattccactctcccagtcagctcagaaccatctacagccacatctccaatggttcctgcctccagcatgggggacgctcttgcttctatatcaatacctggttctgagaccacagacattgagggagagccaacatcctccctgactgctggacgaaaagagaacagcaccctccaggagatgaactcaactacagagtcaaacatcatcctctccaatgtgtctgtgggggctattactgaagccacaaaaatggaagtcccctcttttgatgcaacattcataccaactcctgctcagtcaacaaagttcccagatattttctcagtagccagcagtagactttcaaactctcctcccatgacaatatctacccacatgaccaccacccagacagggtcttctggagctacatcaaagattccacttgccttagacacatcaaccttggaaacctcagcagggactccatcagtggtgactgaggggtttgcccactcaaaaataaccactgcaatgaacaatgatgtcaaggacgtgtcacagacaaaccctccctttcaggatgaagccagctctccctcttctcaagcacctgtccttgtcacaaccttaccttcttctgttgctttcacaccgcaatggcacagtacctcctctcctgtttctatgtcctcagttcttacttcttcactggtaaagaccgcaggcaaggtggatacaagcttagaaacagtgaccagttcacctcaaagtatgagcaacactttggatgacatatcggtcacttcagcagccaccacagatatagagacaacgcatccttccataaacacagtagttaccaatgtggggaccaccggttcagcatttgaatcacattctactgtctcagcttacccagagccatctaaagtcacatctccaaatgttaccacctccaccatggaagacaccacaatttccagatcaatacctaaatcctctaagactacaagaactgagactgagacaacttcctccctgactcctaaactgagggagaccagcgtctcccaggagatcacctcgtccacagagacaagcactgttccttacaaagagctcactggtgccactaccgaggtatccaggacagatgtcacttcctctagcagtacatccttccctggccctgatcagtccacagtgtcactagacatctccacagaaaccaacaccaggctgtctacctccccaataatgacagaatctgcagaaataaccatcaccacccaaacaggtcctcatggggctacatcacaggatacttttaccatggacccatcaaatacaaccccccaggcagggatccactcagctatgactcatggattttcacaattggatgtgaccactcttatgagcagaattccacaggatgtatcatggacaagtcctccctctgtggataaaaccagctccccctcttcctttctgccctcacctgcaatgaccacaccttccctgatttcttctaccttaccagaggataagctctcctctcctatgacttcacttctcacctctggcctagtgaagattacagacatattacgtacacgcttggaacctgtgaccagctcacttccaaatttcagcagcacctcagataagatactggccacttctaaagacagtaaagacacaaaggaaatttttccttctataaacacagaagagaccaatgtgaaagccaacaactctggacatgaatcccattcccctgcactggctgactcagagacacccaaagccacaactcaaatggttatcaccaccactgtgggagatccagctccttccacatcaatgccagtgcatggttcctctgagactacaaacattaagagagagccaacatatttcttgactcctagactgagagagaccagtacctctcaggagtccagctttcccacggacacaagttttctactttccaaagtccccactggtactattactgaggtctccagtacaggggtcatctcttctagcaaaatttccaccccagaccatgataagtccacagtgccacctgacaccttcacaggagagatccccagggtcttcacctcctctattaagacaaaatctgcagaaatgacgatcaccacccaagcaagtcctcctgagtctgcatcgcacagtacccttcccttggacacatcaaccacactttcccagggagggactcattcaactgtgactcagggattcccatactcagaggtgaccactctcatgggcatgggtcctgggaatgtgtcatggatgacaactccccctgtggaagaaaccagctctgtgtcttccctgatgtcttcacctgccatgacatccccttctcctgtttcctccacatcaccacagagcatcccctcctctcctcttcctgtgactgcacttcctacttctgttctggtgacaaccacagatgtgttgggcacaacaagcccagagtctgtaaccagttcacctccaaatttgagcagcatcactcatgagagaccggccacttacaaagacactgcacacacagaagccgccatgcatcattccacaaacaccgcagtgaccaatgtagggacttccgggtctggacataaatcacaatcctctgtcctagctgactcagagacatcgaaagccacacctctgatgagtaccacctccaccctgggggacacaagtgtttccacatcaactcctaatatctctcagactaaccaaattcaaacagagccaacagcatccctgagccctagactgagggagagcagcacgtctgagaagaccagctcaacaacagagacaaatactgccttttcttatgtgcccacaggtgctattactcaggcctccagaacagaaatctcctctagcagaacatccatctcagaccttgatcggtccacaatagcacccgacatctccacaggaatgatcaccaggctcttcacctcccccatcatgacaaaatctgcagaaatgaccgtcaccactcaaacaactactcctggggctacatcacagggtatccttccctgggacacatcaaccacacttttccagggagggactcattcaaccgtgtctcagggattcccacactcagagataaccactcttcggagcagaacccctggagatgtgtcatggatgacaactccccctgtggaagaaaccagctctgggttttccctgatgtcaccttccatgacatccccttctcctgtttcctccacatcaccagagagcatcccctcctctcctctccctgtgactgcacttcttacttctgttctggtgacaaccacaaatgtattgggcacaacaagcccagagcccgtaacgagttcacctccaaatttaagcagccccacacaggagagactgaccacttacaaagacactgcgcacacagaagccatgcatgcttccatgcatacaaacactgcagtggccaacgtggggacctccatttctggacatgaatcacaatcttctgtcccagctgattcagacacatccaaagccacatctccaatgggtaccaccttcgccatgggggatacaagtgtttctacatcaactcctgccttctttgagactagaattcagactgaatcaacatcctctttgattcctggattaagggacaccaggacgtctgaggagatcaacactgtgacagagaccagcactgtcctttcagaagtgcccactactactactactgaggtctccaggacagaagttatcacttccagcagaacaaccatctcagggcctgatcattccaaaatgtcaccctacatctccacagaaaccatcaccaggctctccacttttccttttgtaacaggatccacagaaatggccatcaccaaccaaacaggtcctatagggactatctcacaggctacccttaccctggacacatcaagcacagcttcctgggaagggactcactcacctgtgactcagagatttccacactcagaggagaccactactatgagcagaagtactaagggcgtgtcatggcaaagccctccctctgtggaagaaaccagttctccttcttccccagtgcctttacctgcaataacctcacattcatctctttattccgcagtatcaggaagtagccccacttctgctctccctgtgacttcccttctcacctctggcaggaggaagaccatagacatgttggacacacactcagaacttgtgaccagctccttaccaagtgcaagtagcttctcaggtgagatactcacttctgaagcctccacaaatacagagacaattcacttttcagagaacacagcagaaaccaatatggggaccaccaattctatgcataaactacattcctctgtctcaatccactcccagccatccggacacacacctccaaaggttactggatctatgatggaggacgctattgtttccacatcaacacctggttctcctgagactaaaaatgttgacagagactcaacatcccctctgactcctgaactgaaagaggacagcaccgccctggtgatgaactcaactacagagtcaaacactgttttctccagtgtgtccctggatgctgctactgaggtctccagggcagaagtcacctactatgatcctacattcatgccagcttctgctcagtcaacaaagtccccagacatttcacctgaagccagcagcagtcattctaactctcctcccttgacaatatctacacacaagaccatcgccacacaaacaggtccttctggggtgacatctcttggccaactgaccctggacacatcaaccatagccacctcagcaggaactccatcagccagaactcaggattttgtagattcagaaacaaccagtgtcatgaacaatgatctcaatgatgtgttgaagacaagccctttctctgcagaagaagccaactctctctcttctcaggcacctctccttgtgacaacctcaccttctcctgtaacttccacattgcaagagcacagtacctcctctcttgtttctgtgacctcagtacccacccctacactggcgaagatcacagacatggacacaaacttagaacctgtgactcgttcacctcaaaatttaaggaacaccttggccacttcagaagccaccacagatacacacacaatgcatccttctataaacacagcagtggccaatgtggggaccaccagttcaccaaatgaattctattttactgtctcacctgactcagacccatataaagccacatccgcagtagttatcacttccacctcgggggactcaatagtttccacatcaatgcctagatcctctgcgatgaaaaagattgagtctgagacaactttctccctgatatttagactgagggagactagcacctcccagaaaattggctcatcctcagacacaagcacggtctttgacaaagcattcactgctgctactactgaggtctccagaacagaactcacctcctctagcagaacatccatccaaggcactgaaaagcccacaatgtcaccggacacctccacaagatctgtcaccatgctttctacttttgctggcctgacaaaatccgaagaaaggaccattgccacccaaacaggtcctcatagggcgacatcacagggtacccttacctgggacacatcaatcacaacctcacaggcagggacccactcagctatgactcatggattttcacaattagatttgtccactcttacgagtagagttcctgagtacatatcagggacaagcccaccctctgtggaaaaaaccagctcttcctcttcccttctgtctttaccagcaataacctcaccgtcccctgtacctactacattaccagaaagtaggccgtcttctcctgttcatctgacttcactccccacctctggcctagtgaagaccacagatatgctggcatctgtggccagtttacctccaaacttgggcagcacctcacataagataccgactacttcagaagacattaaagatacagagaaaatgtatccttccacaaacatagcagtaaccaatgtggggaccaccacttctgaaaaggaatcttattcgtctgtcccagcctactcagaaccacccaaagtcacctctccaatggttacctctttcaacataagggacaccattgtttccacatccatgcctggctcctctgagattacaaggattgagatggagtcaacattctccctggctcatgggctgaagggaaccagcacctcccaggaccccatcgtatccacagagaaaagtgctgtccttcacaagttgaccactggtgctactgagacctctaggacagaagttgcctcttctagaagaacatccattccaggccctgatcattccacagagtcaccagacatctccactgaagtgatccccagcctgcctatctcccttggcattacagaatcttcaaatatgaccatcatcactcgaacaggtcctcctcttggctctacatcacagggcacatttaccttggacacaccaactacatcctccagggcaggaacacactcgatggcgactcaggaatttccacactcagaaatgaccactgtcatgaacaaggaccctgagattctatcatggacaatccctccttctatagagaaaaccagcttctcctcttccctgatgccttcaccagccatgacttcacctcctgtttcctcaacattaccaaagaccattcacaccactccttctcctatgacctcactgctcacccctagcctagtgatgaccacagacacattgggcacaagcccagaacctacaaccagttcacctccaaatttgagcagtacctcacatgagatactgacaacagatgaagacaccacagctatagaagccatgcatccttccacaagcacagcagcgactaatgtggaaaccaccagttctggacatgggtcacaatcctctgtcctagctgactcagaaaaaaccaaggccacagctccaatggataccacctccaccatggggcatacaactgtttccacatcaatgtctgtttcctctgagactacaaaaattaagagagagtcaacatattccttgactcctggactgagagagaccagcatttcccaaaatgccagcttttccactgacacaagtattgttctttcagaagtccccactggtactactgctgaggtctccaggacagaagtcacctcctctggtagaacatccatccctggcccttctcagtccacagttttgccagaaatatccacaagaacaatgacaaggctctttgcctcgcccaccatgacagaatcagcagaaatgaccatccccactcaaacaggtccttctgggtctacctcacaggatacccttaccttggacacatccaccacaaagtcccaggcaaagactcattcaactttgactcagagatttccacactcagagatgaccactctcatgagcagaggtcctggagatatgtcatggcaaagctctccctctctggaaaatcccagctctctcccttccctgctgtctttacctgccacaacctcacctcctcccatttcctccacattaccagtgactatctcctcctctcctcttcctgtgacttcacttctcacctctagcccggtaacgaccacagacatgttacacacaagcccagaacttgtaaccagttcacctccaaagctgagccacacttcagatgagagactgaccactggcaaggacaccacaaatacagaagctgtgcatccttccacaaacacagcagcgtccaatgtggagattcccagctctggacatgaatccccttcctctgccttagctgactcagagacatccaaagccacatcaccaatgtttattacctccacccaggaggatacaactgttgccatatcaacccctcacttcttggagactagcagaattcagaaagagtcaatttcctccctgagccctaaattgagggagacaggcagttctgtggagacaagctcagccatagagacaagtgctgtcctttctgaagtgtccgttggtgctactactgagatctccaggacagaagtcacctcctctagcagaacatccatctctggttctgctgagtccacaatgttgccagaaatatccaccacaagaaaaatcattaagttccctacttcccccatcctggcagaatcatcagaaatgaccatcaagacccaaacaagtcctcctgggtctacatcagagagtacctttacattagacacatcaaccactccctccttggtaataacccattcgactatgactcagagattgccacactcagagataaccactcttgtgagtagaggtgctggggatgtgccacggcccagctctctccctgtggaagaaacaagccctccatcttcccagctgtctttatctgccatgatctcaccttctcctgtttcttccacattaccagcaagtagccactcctcttctgcttctgtgacttcacttctcacaccaggccaagtgaagactactgaggtgttggacgcaagtgcagaacctgaaaccagttcacctccaagtttgagcagcacctcagttgaaatactggccacctctgaagtcaccacagatacggagaaaattcatcctttctcaaacacggcagtaaccaaagttggaacttccagttctggacatgaatccccttcctctgtcctacctgactcagagacaaccaaagccacatcggcaatgggtaccatctccattatgggggatacaagtgtttctacattaactcctgccttatctaacactaggaaaattcagtcagagccagcttcctcactgaccaccagattgagggagaccagcacctctgaagagaccagcttagccacagaagcaaacactgttctttctaaagtgtccactggtgctactactgaggtctccaggacagaagccatctcctttagcagaacatccatgtcaggccctgagcagtccacaatgtcacaagacatctccataggaaccatccccaggatttctgcctcctctgtcctgacagaatctgcaaaaatgaccatcacaacccaaacaggtccttcggagtctacactagaaagtacccttaatttgaacacagcaaccacaccctcttgggtggaaacccactctatagtaattcagggatttccacacccagagatgaccacttccatgggcagaggtcctggaggtgtgtcatggcctagccctccctttgtgaaagaaaccagccctccatcctccccgctgtctttacctgccgtgacctcacctcatcctgtttccaccacattcctagcacatatccccccctctccccttcctgtgacttcacttctcacctctggcccggcgacaaccacagatatcttgggtacaagcacagaacctggaaccagttcatcttcaagtttgagcaccacctcccatgagagactgaccacttacaaagacactgcacatacagaagccgtgcatccttccacaaacacaggagggaccaatgtggcaaccaccagctctggatataaatcacagtcctctgtcctagctgactcatctccaatgtgtaccacctccaccatgggggatacaagtgttctcacatcaactcctgccttccttgagactaggaggattcagacagagctagcttcctccctgacccctggattgagggagtccagtggctctgaagggaccagctcaggcaccaagatgagcactgtcctctctaaagtgcccactggtgctactactgagatctccaaggaagacgtcacctccatcccaggtcccgctcaatccacaatatcaccagacatctccacaagaaccgtcagctggttctctacatcccctgtcatgacagaatcagcagaaataaccatgaacacccatacaagtcctttaggggccacaacacaaggcaccagtactttggccacgtcaagcacaacctctttgacaatgacacactcaactatatctcaaggattttcacactcacagatgagcactcttatgaggaggggtcctgaggatgtatcatggatgagccctccccttctggaaaaaactagaccttccttttctctgatgtcttcaccagccacaacttcaccttctcctgtttcctccacattaccagagagcatctcttcctctcctcttcctgtgacttcactcctcacgtctggcttggcaaaaactacagatatgttgcacaaaagctcagaacctgtaaccaactcacctgcaaatttgagcagcacctcagttgaaatactggccacctctgaagtcaccacagatacagagaaaactcatccttcttcaaacagaacagtgaccgatgtggggacctccagttctggacatgaatccacttcctttgtcctagctgactcacagacatccaaagtcacatctccaatggttattacctccaccatggaggatacgagtgtctccacatcaactcctggcttttttgagactagcagaattcagacagaaccaacatcctccctgacccttggactgagaaagaccagcagctctgaggggaccagcttagccacagagatgagcactgtcctttctggagtgcccactggtgccactgctgaagtctccaggacagaagtcacctcctctagcagaacatccatctcaggctttgctcagctcacagtgtcaccagagacttccacagaaaccatcaccagactccctacctccagcataatgacagaatcagcagaaatgatgatcaagacacaaacagatcctcctgggtctacaccagagagtactcatactgtggacatatcaacaacacccaactgggtagaaacccactcgactgtgactcagagattttcacactcagagatgaccactcttgtgagcagaagccctggtgatatgttatggcctagtcaatcctctgtggaagaaaccagctctgcctcttccctgctgtctctgcctgccacgacctcaccttctcctgtttcctctacattagtagaggatttcccttccgcttctcttcctgtgacttctcttctcacccctggcctggtgataaccacagacaggatgggcataagcagagaacctggaaccagttccacttcaaatttgagcagcacctcccatgagagactgaccactttggaagacactgtagatacagaagacatgcagccttccacacacacagcagtgaccaacgtgaggacctccatttctggacatgaatcacaatcttctgtcctatctgactcagagacacccaaagccacatctccaatgggtaccacctacaccatgggggaaacgagtgtttccatatccacttctgacttctttgagaccagcagaattcagatagaaccaacatcctccctgacttctggattgagggagaccagcagctctgagaggatcagctcagccacagagggaagcactgtcctttctgaagtgcccagtggtgctaccactgaggtctccaggacagaagtgatatcctctaggggaacatccatgtcagggcctgatcagttcaccatatcaccagacatctctactgaagcgatcaccaggctttctacttcccccattatgacagaatcagcagaaagtgccatcactattgagacaggttctcctggggctacatcagagggtaccctcaccttggacacctcaacaacaaccttttggtcagggacccactcaactgcatctccaggattttcacactcagagatgaccactcttatgagtagaactcctggagatgtgccatggccgagccttccctctgtggaagaagccagctctgtctcttcctcactgtcttcacctgccatgacctcaacttcttttttctccacattaccagagagcatctcctcctctcctcatcctgtgactgcacttctcacccttggcccagtgaagaccacagacatgttgcgcacaagctcagaacctgaaaccagttcacctccaaatttgagcagcacctcagctgaaatattagccacgtctgaagtcaccaaagatagagagaaaattcatccctcctcaaacacacctgtagtcaatgtagggactgtgatttataaacatctatccccttcctctgttttggctgacttagtgacaacaaaacccacatctccaatggctaccacctccactctggggaatacaagtgtttccacatcaactcctgccttcccagaaactatgatgacacagccaacttcctccctgacttctggattaagggagatcagtacctctcaagagaccagctcagcaacagagagaagtgcttctctttctggaatgcccactggtgctactactaaggtctccagaacagaagccctctccttaggcagaacatccaccccaggtcctgctcaatccacaatatcaccagaaatctccacggaaaccatcactagaatttctactcccctcaccacgacaggatcagcagaaatgaccatcacccccaaaacaggtcattctggggcatcctcacaaggtacctttaccttggacacatcaagcagagcctcctggccaggaactcactcagctgcaactcacagatctccacactcagggatgaccactcctatgagcagaggtcctgaggatgtgtcatggccaagccgcccatcagtggaaaaaactagccctccatcttccctggtgtctttatctgcagtaacctcaccttcgccactttattccacaccatctgagagtagccactcatctcctctccgggtgacttctcttttcacccctgtcatgatgaagaccacagacatgttggacacaagcttggaacctgtgaccacttcacctcccagtatgaatatcacctcagatgagagtctggccacttctaaagccaccatggagacagaggcaattcagctttcagaaaacacagctgtgactcagatgggcaccatcagcgctagacaagaattctattcctcttatccaggcctcccagagccatccaaagtgacatctccagtggtcacctcttccaccataaaagacattgtttctacaaccatacctgcttcctctgagataacaagaattgagatggagtcaacatccaccctgacccccacaccaagggagaccagcacctcccaggagatccactcagccacaaagccaagcactgttccttacaaggcactcactagtgccacgattgaggactccatgacacaagtcatgtcctctagcagaggacctagccctgatcagtccacaatgtcacaagacatatccagtgaagtgatcaccaggctctctacctcccccatcaaggcagaatctacagaaatgaccattaccacccaaacaggttctcctggggctacatcaaggggtacccttaccttggacacttcaacaacttttatgtcagggacccactcaactgcatctcaaggattttcacactcacagatgaccgctcttatgagtagaactcctggagatgtgccatggctaagccatccctctgtggaagaagccagctctgcctctttctcactgtcttcacctgtcatgacctcatcttctcccgtttcttccacattaccagacagcatccactcttcttcgcttcctgtgacatcacttctcacctcagggctggtgaagaccacagagctgttgggcacaagctcagaacctgaaaccagttcacccccaaatttgagcagcacctcagctgaaatactggccaccactgaagtcactacagatacagagaaactggagatgaccaatgtggtaacctcaggttatacacatgaatctccttcctctgtcctagctgactcagtgacaacaaaggccacatcttcaatgggtatcacctaccccacaggagatacaaatgttctcacatcaacccctgccttctctgacaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggaaaccaagtttctaaccaacccctcctttttgaccccagtaggattcaaacaaagtcaaagctctcactgactcctgggttgatggagaccagcatctctgaagagaccagctctgccacagaaaaaagcactgtcctttctagtgtgcccactggtgctactactgaggtctccaggacagaagccatctcttctagcagaacatccatcccaggccctgctcaatccacaatgtcatcagacacctccatggaaaccatcactagaatttctacccccctcacaaggaaagaatcaacagacatggccatcacccccaaaacaggtccttctggggctacctcgcagggtacctttaccttggactcatcaagcacagcctcctggccaggaactcactcagctacaactcagagatttccacagtcagtggtgacaactcctatgagcagaggtcctgaggatgtgtcatggccaagcccgctgtctgtggaaaaaaacagccctccatcttccctggtatcttcatcttcagtaacctcaccttcgccactttattccacaccatctgggagtagccactcctctcctgtccctgtcacttctcttttcacctctatcatgatgaaggccacagacatgttggatgcaagtttggaacctgagaccacttcagctcccaatatgaatatcacctcagatgagagtctggccacttctaaagccaccacggagacagaggcaattcacgtttttgaaaatacagcagcgtcccatgtggaaaccaccagtgctacagaggaactctattcctcttccccaggcttctcagagccaacaaaagtgatatctccagtggtcacctcttcctctataagagacaacatggtttccacaacaatgcctggctcctctggcattacaaggattgagatagagtcaatgtcatctctgacccctggactgagggagaccagaacctcccaggacatcacctcatccacagagacaagcactgtcctttacaagatgtcctctggtgccactcctgaggtctccaggacagaagttatgccctctagcagaacatccattcctggccctgctcagtccacaatgtcactagacatctccgatgaagttgtcaccaggctgtctacctctcccatcatgacagaatctgcagaaataaccatcaccacccaaacaggttattctctggctacatcccaggttacccttcccttgggcacctcaatgacctttttgtcagggacccactcaactatgtctcaaggactttcacactcagagatgaccaatcttatgagcaggggtcctgaaagtctgtcatggacgagccctcgctttgtggaaacaactagatcttcctcttctctgacatcattacctctcacgacctcactttctcctgtgtcctccacattactagacagtagcccctcctctcctcttcctgtgacttcacttatcctcccaggcctggtgaagactacagaagtgttggatacaagctcagagcctaaaaccagttcatctccaaatttgagcagcacctcagttgaaataccggccacctctgaaatcatgacagatacagagaaaattcatccttcctcaaacacagcggtggccaaagtgaggacctccagttctgttcatgaatctcattcctctgtcctagctgactcagaaacaaccataaccataccttcaatgggtatcacctccgctgtggacgataccactgttttcacatcaaatcctgccttctctgagactaggaggattccgacagagccaacattctcattgactcctggattcagggagactagcacctctgaagagaccacctcaatcacagaaacaagtgcagtcctttatggagtgcccactagtgctactactgaagtctccatgacagaaatcatgtcctctaatagaacacacatccctgactctgatcagtccacgatgtctccagacatcatcactgaagtgatcaccaggctctcttcctcatccatgatgtcagaatcaacacaaatgaccatcaccacccaaaaaagttctcctggggctacagcacagagtactcttaccttggccacaacaacagcccccttggcaaggacccactcaactgttcctcctagatttttacactcagagatgacaactcttatgagtaggagtcctgaaaatccatcatggaagagctctccctttgtggaaaaaactagctcttcatcttctctgttgtccttacctgtcacgacctcaccttctgtttcttccacattaccgcagagtatcccttcctcctctttttctgtgacttcactcctcaccccaggcatggtgaagactacagacacaagcacagaacctggaaccagtttatctccaaatctgagtggcacctcagttgaaatactggctgcctctgaagtcaccacagatacagagaaaattcatccttcttcaagcatggcagtgaccaatgtgggaaccaccagttctggacatgaactatattcctctgtttcaatccactcggagccatccaaggctacatacccagtgggtactccctcttccatggctgaaacctctatttccacatcaatgcctgctaattttgagaccacaggatttgaggctgagccattttctcatttgacttctggatttaggaagacaaacatgtccctggacaccagctcagtcacaccaacaaatacaccttcttctcctgggtccactcaccttttacagagttccaagactgatttcacctcttctgcaaaaacatcatccccagactggcctccagcctcacagtatactgaaattccagtggacataatcaccccctttaatgcttctccatctattacggagtccactgggataacctccttcccagaatccaggtttactatgtctgtaacagaaagtactcatcatctgagtacagatttgctgccttcagctgagactatttccactggcacagtgatgccttctctatcagaggccatgacttcatttgccaccactggagttccacgagccatctcaggttcaggtagtccattctctaggacagagtcaggccctggggatgctactctgtccaccattgcagagagcctgccttcatccactcctgtgccattctcctcttcaaccttcactaccactgattcttcaaccatcccagccctccatgagataacttcctcttcagctaccccatatagagtggacaccagtcttgggacagagagcagcactactgaaggacgcttggttatggtcagtactttggacacttcaagccaaccaggcaggacatcttcaacacccattttggataccagaatgacagagagcgttgagctgggaacagtgacaagtgcttatcaagttccttcactctcaacacggttgacaagagaatgcgcatggcgagaagggagaagtgtagttggatggataaaaggaagaatggagagaagagtgaatggaaggaagcaaagatgaagcggaggaaggatagatgcacagaaggaaggatgaaaagaaagaaagatgatggaagacaggattgaaggggatatagattgaaggaaagaaaggtagaaggatgaaatgaagtaaagattgaagaaaagatggatggaaagaagaaaggagggtgcacaaaaaatctcacacttcaccacatatgattcatccatataagaaaaaaccacttgtaccctcaaagctattgaaatacaaacttttaaattaaaattttaaaaagcaagagaaaggaaagaagggaggaaagacaaaaggaagaatgggtgatagaaggaaagaataaaaggaagaaaaaatggaagaatagatgatcagatctagggatgaatgaaaggaaggatggacaaatctataggtaggtggatggatctatggacaggtgtggccacttatggcacatagtcccagctccagttcatactgatggacttgaggagtgtttgtggccaatgaagtggatccatttagacagtgctcttcttctgaatgagatgagttaccccagtttttctccccaccttcatcttcaggaactgatggcattatggaacacatcacaaaaatacccaatgaagcagcacacagaggtaccataagaccagtcaaaggccctcagacatccacttcgcctgccagtcctaaaggtaggtttaactttgcttacctcccagtaatgccactcgtgaccatatttcctcctccagagagacaaaatgtttgtattctttagagagagaattgtgtgtggttgtcataggtttccctgtctgaactgagtctttatctaatggttaccaggcagatgttaccactgtctctttctcctcatggcatgctgagtgagttttgtccaacatcaaatattcacaaatttgtccatattaaccaaattttaaaaatgctcattaaaaacttactatgagctgggcgcagtggctcatgcctgtaatcccaatactttgggaggctgagctgggtggatcaccagaggtcaaaaattcgagaccagtctgaccaaaatggtgaaactccatctctactgaaaatataaaaattagccgggcatggtggcacacaccgtaatcacagctactcaggaggctgaggcaagagagtcacttgaaccacaggaggtagaggctgcagtgagctgagcattgtgccaatgcactccagcctgggtggcagagcaagactccagctcagaaataaataatatattatatatatatatatatgttttatttagatggaatatactatatatatatgtatatatatatgtatgtatatatatatatgtatgtatatatatatatatatatatatatatatatatagagagagagagagagagagagagagagagagacagagtatgtctgagaatgcatcccgatagttctagcaaggtaggaaaaggaagtatcataacagccttgaagtagcctgttgaaacagacagactctcttgtaagagaactcacaaaatctaggattatatctcccatgatgaaaaatttggaactgtacatttttgtttaactgtcacttaaatnnnnnnnnnnnnnnnnnnnnnnnnnnnnnnnnnnnnnnnnnnnnnnnnnnnnnnnnnccaggaggcactgtgcttggcgcctttttaccaacactttgagatggccattgtacttatccccactttatagacgggaaaatggaggtccagcaatattttttaacttaaagagccacccatctctttagagaaagagccagaatcccaggcaggggctatcttattccagagcccaagctctcaaacacatgatacacaatacttaatctctctcaagtcagaggagatccacttaagtatacatccatccacatattcattcattcaatcattcaacaaatattagttgagcacttaccgtatgccaaacagtcaaacgtgaatagctgttacaaatgagactgtgaaggatggtacaacgcagattcagacagtgtgataaggaaatattgagaagcaaagatgagttctggagtgaatttgtaaaggtggatgtgggcttggatttcaataatggcagaacttaaggaatctgatgagaagtgggcacttcaggcagagagaagagcttgaacaaggctcagaggctgacagtgcaggaaacacatgggaagagggaatagagtagcggtcaagaattcacagaggagttataggtgaagatgcaaccaagttacagaccaaggtaagataggggaataccaatcacaatctcttttcccattccagaagcatcccagacacatcctagtaaccgagagacatttctctccctttcctcctgtggagaataaataagctattgcaagtccagtaagtgtaatcattttgttcaaattgtgtgcccattccccaatttacaggactacacacaggagggacaaaaagaatggagaccacaaccacagctctgaagaccaccaccacagctctgaagaccacttccagagccaccttgaccaccagtgtctatactcccactttgggaacactgactcccctcaatgcatcaatgcaaatggccagcacaatccccacagaaatgatgatcacaaccccatatgttttccctgatgttccagaaacgacatcctcattggctaccagcctgggagcagaaaccagcacagctcttcccaggacaaccccatctgttttcaatagagaatcagagaccacagcctcactggtctctcgttctggggcagagagaagtccggttattcaaactctagatgtttcttctagtgagccagatacaacagcttcatgggttatccatcctgcagagaccatcccaactgtttccaagacaacccccaattttttccacagtgaattagacactgtatcttccacagccaccagtcatggggcagacgtcagctcagccattccaacaaatatctcacctagtgaactagatgcactgaccccactggtcactatttcggggacagatactagtacaacattcccaacactgactaagtccccacatgaaacagagacaagaaccacatggctcactcatcctgcagagaccagctcaactattcccagaacaatccccaatttttctcatcatgaatcagatgccacaccttcaatagccaccagtcctggggcagaaaccagttcagctattccaattatgactgtctcacctggtgcagaagatctggtgacctcacaggtcactagttctgggacagacagaaatatgactattccaactttgactctttctcctggtgaaccaaagacgatagcctcattagtcacccatcctgaagcacagacaagttcggccattccaacttcaactatctcgcctgctgtatcacggttggtgacctcaatggtcaccagtttggcggcaaagacaagtacaactaatcgagctctgacaaactcccctggtgaaccagctacaacagtttcattggtcacgcatcctgcacagaccagcccaacagttccctggacaacttccatttttttccatagtaaatcagacaccacaccttcaatgaccaccagtcatggggcagaatccagttcagctgttccaactccaactgtttcaactgaggtaccaggagtagtgacccctttggtcaccagttctagggcagtgatcagtacaactattccaattctgactctttctcctggtgaaccagagaccacaccttcaatggccaccagtcatggggaagaagccagttctgctattccaactccaactgtttcacctggggtaccaggagtggtgacctctctggtcactagttctagggcagtgactagtacaactattccaattctgactttttctcttggtgaaccagagaccacaccttcaatggccaccagtcatgggacagaagctggctcagctgttccaactgttttacctgaggtaccaggaatggtgacctctctggttgctagttctagggcagtaaccagtacaactcttccaactctgactctttctcctggtgaaccagagaccacaccttcaatggccaccagtcatggggcagaagccagctcaactgttccaactgtttcacctgaggtaccaggagtggtgacctctctggtcactagttctagtggagtaaacagtacaagtattccaactctgattctttctcctggtgaactagaaaccacaccttcaatggccaccagtcatggggcagaagccagctcagctgttccaactccaactgtttcacctggggtatcaggagtggtgacccctctggtcactagttccagggcagtgaccagtacaactattccaattctaactctttcttctagtgagccagagaccacaccttcaatggccaccagtcatggggtagaagccagctcagctgttctaactgtttcacctgaggtaccaggaatggtgacctctctggtcactagttctagagcagtaaccagtacaactattccaactctgactatttcttctgatgaaccagagaccacaacttcattggtcacccattctgaggcaaagatgatttcagccattccaactttagctgtctcccctactgtacaagggctggtgacttcactggtcactagttctgggtcagagaccagtgcgttttcaaatctaactgttgcctcaagtcaaccagagaccatagactcatgggtcgctcatcctgggacagaagcaagttctgttgttccaactttgactgtctccactggtgagccgtttacaaatatctcattggtcacccatcctgcagagagtagctcaactcttcccaggacaacctcaaggttttcccacagtgaattagacactatgccttctacagtcaccagtcctgaggcagaatccagctcagccatttcaacaactatttcacctggtataccaggtgtgctgacatcactggtcactagctctgggagagacatcagtgcaacttttccaacagtgcctgagtccccacatgaatcagaggcaacagcctcatgggttactcatcctgcagtcaccagcacaacagttcccaggacaacccctaattattctcatagtgaaccagacaccacaccatcaatagccaccagtcctggggcagaagccacttcagattttccaacaataactgtctcacctgatgtaccagatatggtaacctcacaggtcactagttctgggacagacaccagtataactattccaactctgactctttcttctggtgagccagagaccacaacctcatttatcacctattctgagacacacacaagttcagccattccaactctccctgtctcccctggtgcatcaaagatgctgacctcactggtcatcagttctgggacagacagcactacaactttcccaacactgacggagaccccatatgaaccagagacaacagccatacagctcattcatcctgcagagaccaacacaatggttcccaggacaactcccaagttttcccatagtaagtcagacaccacactcccagtagccatcaccagtcctgggccagaagccagttcagctgtttcaacgacaactatctcacctgatatgtcagatctggtgacctcactggtccctagttctgggacagacaccagtacaaccttcccaacattgagtgagaccccatatgaaccagagactacagccacgtggctcactcatcctgcagaaaccagcacaacggtttctgggacaattcccaacttttcccataggggatcagacactgcaccctcaatggtcaccagtcctggagtagacacgaggtcaggtgttccaactacaaccatcccacccagtataccaggggtagtgacctcacaggtcactagttctgcaacagacactagtacagctattccaactttgactccttctcctggtgaaccagagaccacagcctcatcagctacccatcctgggacacagactggcttcactgttccaattcggactgttccctctagtgagccagatacaatggcttcctgggtcactcatcctccacagaccagcacacctgtttccagaacaacctccagtttttcccatagtagtccagatgccacacctgtaatggccaccagtcctaggacagaagccagttcagctgtactgacaacaatctcacctggtgcaccagagatggtgacttcacagatcactagttctggggcagcaaccagtacaactgttccaactttgactcattctcctggtatgccagagaccacagccttattgagcacccatcccagaacagagacaagtaaaacatttcctgcttcaactgtgtttcctcaagtatcagagaccacagcctcactcaccattagacctggtgcagagactagcacagctctcccaactcagacaacatcctctctcttcaccctacttgtaactggaaccagcagagttgatctaagtccaactgcttcacctggtgtttctgcaaaaacagccccactttccacccatccagggacagaaaccagcacaatgattccaacttcaactctttcccttggtttactagagactacaggcttactggccaccagctcttcagcagagaccagcacgagtactctaactctgactgtttcccctgctgtctctgggctttccagtgcctctataacaactgataagccccaaactgtgacctcctggaacacagaaacctcaccatctgtaacttcagttggacccccagaattttccaggactgtcacaggcaccactatgaccttgataccatcagagatgccaacaccacctaaaaccagtcatggagaaggagtgagtccaaccactatcttgagaactacaatggttgaagccactaatttagctaccacaggttccagtcccactgtggccaagacaacaaccaccttcaatacactggctggaagcctctttactcctctgaccacacctgggatgtccaccttggcctctgagagtgtgacctcaagaacaagtaagaataacttttttattgtggtaaaatataaatactataaaaattgccattctaaacattttaattgtacaactcagcagtactaatacattcacattgttgtgcaaccctcaccactatctgttttcaaaactttttttatcaccccaaacaggactgaaggaataatttcccattccccattctccctagtgcagtggtgcaatctcggctcaccacaacctctgaacctctgtctcctgggttcaagcaattctcctgcatcagcctcctgagtagttgggactacaggtgcacgccaccgtgcctggctaatttttgtatttttagtacagacagggttttaccatgttggtcaggctggtctcaaactcctgacctcaggtggtccacacgccttggcctcccaaagtgctgggattacaagtgtgagacactgtgcccggccatatctgttagatcttactaatcctgtcaagaggattcagtgtccttttttttttttctttcttttttttgatagagtctccctctggcacccaggctggagtgcagtggtacggtcttggctcactgcagcctccacctcccagactgaagcgattctcctgcctcagcctcccgaatagctgggactacaggcgcgtgccaccacgcccagctaatttttgcatttttagtagagatgggatttcactatgttggccaggctggtctcaaactcctgatctcaagtgatccgcccaagggcctcccaaagtactgggattacaggtaggagccacctcacctggccctattttcggaatggatttttttttaatgtttaaaatgtcacctaagattattgtgaagatcaaataagataaaatcctaataacccaagtaaaccacagggctccacttggaccagtctcagaagtttcaagaaaatcagtcagaccatcaaatgtaaaataagtctaaattttctttgcactattcacagagtgccaaagaggatctaattcatgtttcagaacataccctacttactaaaatccccttttcctcatttcttctcattctgcaactttatcatctcctgcggaccccctagcctctcccctccccatagtcagtctctctctctctctttccctcccctcttattatctcaatttcacacgaaagaattccagaaactatactgccaaaagtctttcctgtctttgaaaagttgggaaagaggagaaactcagacagcaatgacaaaattatacgtaatggatgaaggaaacacaaataaggctggaaacagaaaattttgtccccatcatttatttaatgaaggtggcagtattccagccacatagtgaacccccacaataagaaggggcctctggcgattgattattgtcattgttgttaatgataatgagggtgaggatatcatgagcatcagtgtaggaggcagttaactaataagaccaagctgttggctgggcgtgctggttcacacctgcagtcccagcactttgggaggccaaagtgggtggatcacttgaggtcaggagttcaagactagcctggccaacatggtgaaacctggtctctaccaaaaatacaaaaattagtcaggtgtggtggcgtgtgcctgtaatgacaactacttgggaggctgaggcaggagaatcacttgaacctgggaggcggaggctgcagtgagatgagcttgaaccactgcactccagcccgggcaacagagagagactcttgtctcaaaaaacaaaacaaacaaacaaaaactaaaccaaacaaaaaaagactagctgttattcatttatttatttatttatttagagacggagtctcgctctgtcacccaggctggagtgcagcggcacaatcttggctcactgcaacctctgcctcccaggttcatgtgattctcccgcctcagcctccccagctgttgttattcatgaatgaacctcagagaaagcacacaggagggttggtgcacctgtgttttgagttctacccctccttcctctcttaacttcctcctgtcttctcactctgattcgttcttccttcctctccctctctctctgcaggttataaccatcggtcctggatctccaccaccagcagtgagtaaacatggccctgaagtccctatgccctgggaattcttcctccctaagcctgccttccaggaggaaagtatcccccattccctaggttctcatccccacagaaactccagaatagcaaaagtctcaggctgagccaaggcacagatgccagtgctcaccaagagtcctattctcccctcgctaaatgataggacccaacaaacccgattcacgctgcgttttctttcagctccgatgacctccatgttctctccaaggcctctcgtatctgtgagccccacccccagcgctacaggtaggaatctggcttccagctcccatgaaacgtcggctgccattcagtggctgattaattgctgtgtggtctgagtcctgatgcccaccaagtctcagcgtgttcccctctgtccaatctcatccaacaatttaagctaatgcttgtttaatgatgtcctcactataccaccttggacactttctttttgcctggatttaaagcttccatttctttccttccttccttcttttcttccttccttccttccttccttccttccttccttccttccttccttccttccttccttcctccttccttccttcctttcttcctttcttcctgtctttttctttctttccttcttttggcagagtctcactctgtcgcccaggctggagtgcaatggtgcaatctcggttcactgcaacctctgcctcccaggttcaagcgattctcatgccacatgccactatgcctggctaatttttgtttttttgttttttggggggttttttgagacagagtctcagtctgttgcccaagctggagtgcagtggcatgatctcgggtcactgcaacctccttctcccaggttcaagcgattttcctgcctcagcctcctgagtagctggaactacaggcacgcaccatcacaccggctaattttttgtgtttttagtagagacgacggttttgcaatgtgggccaggcttgtctcgaactcctgacctcaagtgatcctccagcctcggcctctcaaagtgctgggattacaagtgtgagccactgcaccaggccaaaaacttgtatttcaatagtcattgaggctgggtgcagtggctcacgcctgtaatcccagcactttgggaggctgaggccagtggatcatgaggtcaggagatcaagaccaccctggctaacacagtgaaaccccatctctactaaaaatacacacaaaaattagccgggcatggtggcaagatgcctgtagtcccagctactcaggaggctgaggcaggagaatggcgtgaacctgggaggcagagcttgcagtgagcggagatcgcaccgctgcactccagcctgggcaacagagagcgactctgtctcaaaaaaaaaaatatatatatatatatatatatattcattgagaccgactctgacttaaaagcagtaatgaatggtgtaggttttggtaaattacaggtcttgctttaagtcctggtcctctcttttgctcactgtgtggccccggaagagccatgtaacctctccaggcttcagtgtccatttttagaacggagtaagtgaataagctgtgtccaatcatctctggccatatcagcttcattttttttttcctccagggtccaaacatccctccaccctcagagtctttgcacctggtgttcttgtccttcaaatctcagcttggatcaccctttataaagtagcatttcccccgtatacgcatcttgcacacagccaatctctattctacctctatgctcacttccttcctggcaattattactacagctgggcccttgaacagcatgagggttcagggtgctgacccctatgcattcaaaaatccacatataacttttttttttttgagatggagtttcacacttgttgcccaggctggagtgcagtggcgccatcttggctcactgcaaactctgcctcctgggttcaagtgattctcctgcctcagcctcctgagtagctgggattacaggcatgtgccaccatgcccagctaattttgtatttttagtagagatgaggtttctccatgttcgccaggctgctcttgaactcctgacttcaggtgatccgcctgccttggcctcccaaagtgctgggattacaggcatgagccatgatgcccggccatttgctaatggcatctagtaagtagaggccagagatgttgcaaaacatccaacaatgcacaaagcagcctcctatcaaaacacattatccagaccaaaatgtcaatagggctgaggttgagcatctgctgtacacagattccaagttctggtacaaatctcgtagttctctgagggctcatctttcaatgcctagcacatcaaaggaggccaatttcctcttccctttcacctcctggtatgaaatgtttcctcctccaccttgatcctgtaagagcccagctggagtttgcagacgacggggaaagaaatgggtgagggagggtcctatggttgagtctccgcagtgggccctgggtgcccagttcaccctcctccccttcattttctccatcatgacaactcaaggcaaattctcagtttccatgggccagtggaatccactgacttcatgaaataaccccaccctgagcaaatacccctcaaataataactgtttacacaacatcagtggcaacaatgacccaagcagcaatgccaccaccagaatagcaaccataacagcagctcattttcatcaaaaggaaactgtagggccaggcacagtggctcacacctatattcccagcattttgggaggctgaggcaggcagatcacctgaggtcaggagttcaagaccagcccagccaacatggtgaaaccccatctctactaaaaatacaaaaactagccaggcttggtggcatgtgcctgtaatcctagctactcgggaggctgaggcaggagaattgcttgaacctgggaggcagaggttgcagtgagctgagattgtgccactgcactccagcctgggcgacagagcaagactccgtctgaaaaaaaaaaaaaaaggaattgtgccaggaattgtgatgagaactttatatgcattatctcctattaatattacccaaacctccgtgagttactatactcatttctacagagagcatttatgcatccagggaggaagtaattagcccagaattactcagttatgacacaggacagtatgaaaactccaaccgaagattggagactcatgaaaactccaggctcctaactacaagacatcactgtggatcgtccaaatagagcaagccccaatctcaggacaggaatgaggcatgaatggcctctatgctaatgatctaacctaatgctgaatttgttacttcccttctgaatccacttggagatttcctttatatctgacttgaaatagaggatatatactcctctatccttgacataggagataatacacagaaagtatttcattgtagtatcaagtacacatcctgttctgtgtccataggattatgactaatttagggcatggcttaacagtgtggtactattgaatgacagacagatgtctgttttgttggatgcaggacaagccatgtaacctccccagactttagtgtcccctctgtggaatggaataaaaatactacgtgggattgttctgataatcaaatgagataattcaggaacaacccagataaataacagggctgccctgggttctgtctttccttgtatctctcacagagcctcaaaggagatgcaatccatgacctagagaaacactcaggacaaattctcttttccccagttcctttcttgctccaatggcaacaccacccctctcatcctgaagtctcttgtttttaccaccacacctattttgccaaattttctccaatattccaaaccatatgaaacctttctttctttcttttctttccttcctttccttctttctttcttttttctcttcttttcttttctttttgagacatggtctcactctgttgcacaggctggagtgcaatggcacgatctttgctcactgcaacctccgcctcccaggttcaagagattctcttgcctcagcctcctgagtagctgggattacaggcgcccaccgccacgccacgctaatttttgtgttcttagtggagacggggtttcgccatgttggccaggctggtcttgaactcctgacctcaagtgatttgcccatctcggtctcccaaagtgctaggattacaggcgtgagccaccaagcccggccccatatgaaccgtttctatccctcatttctctgtacttttacctaaaaacaccactcccttcacccatcacatttttgtcaattctacatcacacacacacacacacacacacacacacacacagagaaagtaagttggaaaaaaattatactatcatgaaattttgtgaaaggaggtaagctgagagagtaagaatcaaactaaattatctttatgggtagaaagcacactcatccatacatgtgtctttccacccttgtaatgtatttattattattgtttgtatatactagattcccaataaatagggacagctattatggtatttttatttcaggaataataatagtgatgatttccaccattattgtcaaaggacaaagcacaaaatatgtaccaaataaaatatagccattatcctttattcacaaaagatcttggccccacctcttctcaatgaaatgtccatgacttgttcaactttggccactctgggctgagagatggaggttcccttgcgagctgaagtcacacatcgaaggtggaagcccctcccctccctctggctggctgagggatagcccagatgggctcatcatgaaagtttcccattatttccatttctggatctaccatcttcccctcccctacctctcacccatcataattgtccttctttactctttcctccctatctgcaggttataaccgtcggtactggacccctgccaccagcagtgagtattcaaacctgtgatattccaatgcccttgggacccttcctccccaaggtgcattcctcagaagagaaactgatcattctccctccctacgtgcccagccacagcctcagagcagcccctaacccgtcaaggtcttggtgtgagtcaagatagaagtccaaattccaatgagcagttcctgtcccatattcctttaggaagacacccaatcatttctccatgttctttttttctcagctccagtgacttctacattctccccagggatttccacatcctccatccccagctccacaggtaggaagctcctctctggcatctatgaaatttaacactgcatggtctgttccctgctgaccacccagactcagcctgttccactcgccctctcactctctctctctctcttttttttttttttttttttttttttttacggagtcttgctctgtcacccaggctggagtggaatggtgtgatctcggctcactgcaaccttcgcctcccaggttcacgtgattctcctgcctcagcctccggagtagctgggattacaggtgcacaccaccatgcctggctaattttttgtatttttagtagagacggggtttcaccatgttggccaggctggtcttgaactcctgacctcaagtgatctacccaccttggcctcccaaagtgctgggattataggcatgagccaccacgccaggcccactctctaaattttgaccaccctgccttgagtggtcttctagcaccctaacctctgtctaacctcgagagctttgcactagcgattcctggggaccagctatggttggtatcttctcaactttctaatttttttaaaattattattattattattattattttaaatggagtctcgctctgtcacccaggctggagtgcagtggcaccatctcggctcattgcaacctctacctcccgggttcatgcaattttcctgcctcagccagaaattttctcagtggtcgagattgtgccactgcactccagcctgggcaatggagctaggctccatctcaaaaaaaaaaaaaaaaagacggaggtcgggcattcctaacccttaaccctgccttgtgattctggagttatgagatagaacctggtgtcccgtaattaaaattccgccttcaggccttatgttttgtgagtcacaacactgcaaactttttacatgctgtagacaggatgttcactctccacttcctcactgctctgctctaatcaattcaaccatttatgtgacatgcctaacccctctgggcttgtacgtatgtaacatgtattacaaagcaagtcattccatgatcaatgctgtcactttttctaggtgctttcaaaatttgttcttcatcattgattttcagtagtttgattacgatgtgtctgggcatggttttctttgagtttatcctgcttaaagtgttctcagcttcttgagtctcaaagtgtttattttctgctctgattctttctccccttcggacctccaatgaaatgatgttgcccgaagagaccctgaggttctgttcattttgttatttatcaatcttttttcctctccgaatttcaggtttaataattttttttttttttttgagacggagtctcgctctgtcgcccaggctggagtgcagtggcgcgatctcggctcaccgcaagctccgccccctgggttcacgccattctcctgcctcagcctccggagtagctgggattacaggcacccgccaccatgcccggctaattttttgtattttttagtagagacggggtttcaccgtattagccaggatggtctcaatctcctgacctcgtgatccgcccgcctcagcctcctaaagagctgggattacaggcgtgagccactgcgcccggcccaggtttaataatttttatagaatattttcacaatcaccaagccttttctctaccagctccattctgcccatccattgaattctttttatctcagttactttatgtttcagttcgaaagtttctacttggttagatagatagatgttatatcatatattatatgttatataaaaatatatttatggttatacatataacatatatgttatatatagttatttatatagccataactatatatagccatatatatagttatatataaccatatatatagttaccatatagtaaccacatatataaaacatatatatatagtgtctctctatatatagttatatatatagtttctatatctgtaactatatatagttatatatgtatgtttctctgtatataaatatatatatttctatatatatagttatacacattatatatataactgggagatgttggtaaaggatggcgtgaggaaacctggagcagtcatggtaatcctcgctctgctccgaactcctcaagagcaggagaagggtcctcctcattctccagccatgttgactttgagcaatttactcatcctctcagtacctcagtttcctcacctgccaattgaggataataatatttcataaattgtttgcaaatgttatatgcaactctacgtaagaacacctagcacaggggctaccagggaatttggtttaacaaatatttatcaggcacctattctgggctgggcaggggggataagatgttgactaagtcaaatgcagtccctcccctcaccaagtttacagtgtattgggcaagactgaaatggaacaagcaattacaattgacaataaaagacaaccaagttattgagcacttactatatggcatgccatatgctatgtattttttttatttttaacttttcattttgaaataaataataaatataaagtaaataataatataaataaataataaataacttttcattttgaaataaataataaataaattcaggagatgttgcgaaaatagtgtagcattcccctgtatccttcacccagtttctccccaatggctacatcttacataactctaatacaatatcaaaagcaggaaactgacattgttaaaatccattttactggttttacacgcgtgtgtgcatatgtgagcttgtgtatgtgcgtgtgtgtgcaggcatgtgtgtgcatgcacgcctgtgtgtgcatatgtgcatgtgtgcatgcgtgtgtgcatgtgtgcatgtgtgtgtgcatgcgtgcgtgcgtgcgtgcatctgtgtgcatgtatgcacatgtgtgtgtgtctgtgcacgtgtgtgcatgcatgtgtgtgtgcgtgtgtgttggtagccctatgcaatttttatcacatgggcatagccctataatcaccaccaccatcaagattcagaactgttccattcccccaaagattcccctcatgctagccttcgtaatcatgcccactgagcccaacactattgcatagaatagctattctactctccatctccatctctgtctctacaattttcttttgaagatgttatataaatggaaatgtacaacatgtcacctttgaaattggcttcttttccactcagtgtaatgccctggagatgtgctctttttaacagtcatgtaaccttcctaatttccctccaaaatatcattatgcccctcgccgccttttttttttttttttttttttgagacagagtctcgctctgttgcccaggctggagtgcagtggtataatctcagctcactgcagcctccgtctcccgggttcaagggattcccctgcctcagcctcccaagtagccaggattacaagtgcatgccaccacgcctggctaatttttgtatttttagtcgagacggggtttcattgtgttggccaggctggtctcgaattcctgacctcaagtgatctgcccgccttggcctcccaaagtgctgggattacaggtgtgagccaccgcgcccgacccatattgcccattgtattacagcggaagaaactgaggtatggacaggtaacatgtccatggtcacttggctggtgaggggcagagaggagatttgaaaccaaatctgactcactagtgtggccgtaaccatggtaactatgtctctctaccatgtggtctcctctttattaaaggaagggcaagttctgggagttttgggagttttgggcttgagtggggaagggtagccaagtaaagcaggtgagagaaggtctgctttaaggactgctgtttgatttttattgttgttgttcagtgttcaatgggattgagttgactcttttttcccttcttgttccccaaagcatgagactgttccggtccttttcccttttaacttctcagctagagtttgttagggcgggtatgggcacctggcagagtctgagacctcagcttccagtaggcacacgttctgacccaatacacctaccctggtcccctaacctgcttctggtcccctaacctgcttctgggcccaggtaatgcattttaggaacatcccacttttctccttacctggctttccattatccgtccaaactaaagcacccacctgtctgcttcagactcttgcttcaagcactccgtctgggtcctcagaaattgacttacagtcagttcagatctgactcaggcgtggccttcttttctccttccttgc

SEQ ID NO: 312 - DNA, 42348 bp, Homo sapiens
  misc_feature (1)..(130): Exon R1
  misc_feature (442)..(510): Exon R2
  misc_feature (2126)..(2250): n is a, c, g, or t
  misc_feature (5479)..(5652): Exon R3
  misc_feature (6301)..(6334): Exon R4
  misc_feature (6593)..(6657): Exon R5
  misc_feature (7558)..(7683): Exon R1
  misc_feature (8216)..(8284): Exon R2
  misc_feature (8877)..(9050): Exon R3
  misc_feature (9380)..(9413): Exon R4
  misc_feature (9675)..(9739): Exon R5
  misc_feature (10082)..(10200): n is a, c, g, or t
  misc_feature (10201)..(10291): Exon R1
  misc_feature (10524)..(10592): Exon R2
  misc_feature (11200)..(11373): Exon R3
  misc_feature (11722)..(11755): Exon R4
  misc_feature (12016)..(12036): Exon R5
  misc_feature (12037)..(12150): n is a, c, g, or t
  misc_feature (12169)..(12295): Exon R1
  misc_feature (12532)..(12600): Exon R2
  misc_feature (13219)..(13392): Exon R3
  misc_feature (13723)..(13756): Exon R4
  misc_feature (14016)..(14077): Exon R5
  misc_feature (15001)..(15126): Exon R1
  misc_feature (15367)..(15435): Exon R2
  misc_feature (15475)..(15601): n is a, c, g, or t
  misc_feature (15648)..(15773): Exon R1
  misc_feature (16002)..(16070): Exon R2
  misc_feature (16653)..(16826): Exon R3
  misc_feature (17158)..(17191): Exon R4
  misc_feature (17453)..(17517): Exon R5
  misc_feature (17866)..(18531): n is a, c, g, or t
  misc_feature (18532)..(18657): Exon R1
  misc_feature (18658)..(18887): n is a, c, g, or t
  misc_feature (18888)..(18956): Exon R2
  misc_feature (18957)..(18995): n is a, c, g, or t
  misc_feature (19633)..(19806): Exon R3
  misc_feature (20093)..(20140): n is a, c, g, or t
  misc_feature (20141)..(20176): Exon R4
  misc_feature (20177)..(20386): n is a, c, g, or t
  misc_feature (20387)..(20449): Exon R5
  misc_feature (20450)..(20483): n is a, c, g, or t
  misc_feature (21609)..(21731): Exon R1
  misc_feature (21940)..(22008): Exon R2
  misc_feature (22605)..(22778): Exon R3
  misc_feature (23109)..(23142): Exon R4
  misc_feature (24607)..(24700): n is a, c, g, or t
  misc_feature (29046)..(29168): Exon R1
  misc_feature (29266)..(29334): Exon R2
  misc_feature (30368)..(30450): n is a, c, g, or t
  misc_feature (33917)..(34090): Exon R3
  misc_feature (35192)..(35259): n is a, c, g, or t
  misc_feature (36702)..(36734): Exon R4
  misc_feature (38270)..(38320): Exon R5
  misc_feature (39104)..(39224): Exon R1
  misc_feature (39315)..(39383): Exon R2
  misc_feature (39532)..(39705): Exon R3
  misc_feature (41862)..(41992): Exon R4
agcagccacagtcccattcatggtgccattcaccctcaacttcaccatcaccaacctgcagtacgaggaggacatgcggcaccctggttccaggaagttcaacgccacagagagagaactgcagggtctggtgagagccccgcccaccgtactcctccctcgcccacttagacaaaccagcccacctcacactgcctcgcccactgatgccagccacgcccacctcatccaaccccagacacctttccctgccccacccactgattttagccaagcccacctcaccccacccagcctactgatgccagccacgcccacctttccctgccccgcccactgatttcagccacgcccacctcaccctggtccacccctccaatgccccactcttcctggcttcccgcagctgttgtttctcacctcccctctccttccttgcagctcaaacccttgttcaggaatagcagtctggaatacctctattcaggctgcagactagcctcactcaggtgagacgctccttaagaaaaacacagcccaacaggtgaatatgaccctagtctctgggctccctgactctgttcatacttggaacaactattgcccatggatactaagcatcaccaccagcagcagcagataactattcctaagacccaaggcactgcattatgtactttatatttaatgcctcatcagtgcttgcaacagcctcatgaagcaggagcagaaggggaaactgaggcccagattaagtggcttgtgccaggacacacaaagcaactgcagcacttcaggttctatatccaaactcctatcccttaggtggcacttcctcctctgcccccattatgaacttgcagcatgtggaaaaccccaatctgacttccctctaagggaacttgcccagagaatctaagaggggaggaaaggaaggcgttcagcccttacaggcaggaggtcagctcctgagtggctcagatgcagccacagagggcctggccggtctgagggtgactgagaggcaccgagggcactgtccctgagtgctggaaagggcaggtcttttagggtagacagcggttgatatcatttcctgcctggcattctcaccttccacacctctctcacagaatctccaagtgtggctctcccaagagagagtgtcagtcatctacctccagcttcctttccttcccagggggaagaggggacaggggggccctagtggctaagagcattggtgaactcaggcagacctcagttctgaaccaacccagctctgccatttactatctgtgactctgagcaagtgcctgaagccttctgtgccctatttcctgacatattatatatataaaatacatatattatatatagacatattttatatacatattgaggcatattttataaacatgtttatagacacatttttatatgcatatgttatatacgtatataacatatgttatatataatgtatatattatacatattgttatattgtatacatgttatatatgttatagcatatatagtacaagttatatataacacatacattatgttacatataatgtatatgttatatatgatatattatatataattatatattatataaaactgttatatataattatatataatatatagttgttatatataattatataattgttatatattatatacaacatataacatacattatatattgttatatataatataatatatacatatataacatatgtataacttttatgttatacataatgtatataacatatatgtgtatgtgtgatgtacataacatatctgacattaacatataacatatgatataacaatattatatgttataacataatatatgttataatataacaatattatatgttataacttatactgtcatatgtaacatatacataatattttataaatcagtttaatatacattatgttacatataatgtatgttatatatgatatattatatataattatattatacataattgttatatataatgcatacattgtatttgttacgtattatatgcaacatatggggatcctctagagtcggaccagcggcagcagctgcctgccttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatacatacataacatatgtataacttatatgttatatataagtatataacatatatgtgtatgtgatgtatataacatatctgacattaacatataacatatgttataatatgacatattatatatattacatataacgtatatcatgtataatataatgtgtatatataatatattaaagtatataagtataaatacatgtaatatttaaatatatattatatatagtatacatgtggatacatacaacttctacatatacctagtatatattctatatataaacagtccatgaattacaatgattcaacttatgatttttcaaactttgtgataatgccatagcaatatgcattcagtagaaagcataccttcaacacccatgcaaccattctgtcattcactttcagtacaatattcaataaattatatgagatattcaacagtttattataaaataggctttgtgttaggtgattttgcccacatgtaggctaatgtaagggttcagagcatgtttaaggtaggataggctaacctatcatgttctgtaggttaggtatagtcgatttttatttttatttttatttttgagacagagtcttgctctgtcacccagactggaatgcactggtgcgatcatagctcactgcagccttgaactcctgggctcaagtgatcctcctacctcagcctcctgagtagctgggactacaggtgtgtgccaccacacctggctattttttttttaatttttttttttttgtggagaggagggtcttgccatgttgcccaggtggccttgaactcctgggctcaaggaatcctcccaccttggcctcccaaaatcctgggattacaggtgtgagccatcacgcccggctacagggcatttttgacttatgacattttcagttcacaatggatttgtcagggctgggcatgatggctcacacctgtcatcccagcactttgggaggctgaggcaggtggatcacttgaggccaggagtttgagaccaggctgtccaaatggcaaaatcttgtctctactaaaaatacaaaaattagccaggcgtggtgtgacaactgtagttccagctactcgggagactgaagcgtgagaatcacttgaacttaggagatggaagttacagtgagtcaagatcacaccaccgcactccagcctggatgacagagcaagactcttgtctccaaaaaacaaaaaacaggctgggtgcatggctcatgcctgtaatcccagcagtttgggaagctgaggcaggtttatcacctgaggtcagtagttcacgatcagcttggcaaacatggagaaaacccatctctactaaaaatacaaaaattagctggatgtggtggtgggtacctgtagtcccagctactcgggaggctgaggcaggagaatggattgaacctgggaggcagaggttgcagtgagccaagatcacaccattgaactccagcctgggcaacagagtgagactccatctccaaaaacaaaagaaagcaaaaacaaaaaaataaaataaaaaacctgtgtttatcaggacataataccatcatgagtcaagaagcatctaaatgtacatggtagttatataaaaatagttatatagttatatacaatagttatatataaaccagtttaatatatgttaagtagaggtatatggtagttatataaaaaatagttatataatagttatagagttatataattatataaaatagttatatataaaccagtttaatatatgttaggtagaggtataataatatatattgtatatactatataatatagtaatgtataaaatgcaaaacgatatcatatatttctatattaagtttatatttacagatctacattttatatattttatgttatatacaattgtgttatacataatataattagtatagtactgacttggggaattgagcagtaccaacccatagggatgtttgaggatgaaaatatgtgattatgaatacaaaatgctgggcctgctgcataggaagtatttaataaatggtagttgttactataaagtcgttcctactatagagctactcacaacctgggacatagggaaagagcccgtttccctctaatcactcaatagtgggtggctaggtaggtgagtccacatcctgtggccgggaacaggtgctgagacatgaagaccttctgactgcatgttggaccagccacagtttcagacggaccagccaaaaagggcattttccccaagccatttagctcccttgagtctcataacaaatctcctagaccctgctggtccataggatctagagaggatgacttgaaccttctgatcccaccatttgaaaacgccatgccatgggcaccagtaggagggccactgctacgtgcaccagtacaagggccactgccatggattacagattaaccctaagtatagctgtcgcacacctagtacttcaggaggcttattcggggccatgcagatccctggcattattatcctaggatcctacaccaagcaaagcaggagctgcccctcctcataaacccataagccctcctcttgagcaaagcagctgggaaggccagaagttattcaagctcccctctgccccggttccaaagacagacagctcaagcctacatgcagcaaaccctataaaagtgtcacctcttggcatttctgccatggtaatgctttctgcttccactaataatcctagtaatttgtttatggtgggcatctctctgatgagaaccacattcttttttttttttttttttttttttgagatagagtctcactctgttgcccagactggagtgcagtggcgcgatctcggctcactgtaacctttggctcctaggttcaagcaattctcctgcctcagcctcccaagtagctgggactgcaggcacgtaccaccatgcccagctaatttttgtatttttagttgagacggggtttcaccatgttagccaggatggtctcaatctcttgacctcatgatccacctgccttggcctcccaaagtgttgggattacaggcatgagccaccatgcctagcctgagagccacattcttgttaaccacaattttctcagagtctgcattaggggttgacaaagagtggaaaggaaggacaaaaggatggagaggtggatggactaagcatatgtaggttcttacccaggccagagaaggatagctcagccacggcagtggatgccatctgcacacatcgccctgaccctgaagacctcggactggacagagagcgactgtactgggagctgagcaatctgacaaatggcatccaggagctgggcccctacaccctggaccggaacagtctctatgtcaatggtgagcagctgtgatgtggttggaggctcttcctccttgctgagcagcctgtaatcactggcttgaggtcacactcactgtcaggcaattgaaaatttggtcctgtgctctacatgggatgactaatttccggacttcatggtatctttttttttttttttttttttttgagatggagtctcgctctgtcaccaggctgaggtgcagtggcatgatctcagctcactgcaacctccgcctcccggattcaagcaattctcctgcctcagcctcctgagtagctgggactacaggtgcatgccaccacacccagctaatttttgtatttttagtagagacagggtttcaccatgttggtcaggatggtctcaatctcttgaccttctactccaccttgccttggcctcccaaagtactgggattacaggcttgagccaccacacctggccaggacttcatggtttcttcatcatcatggaatgaattccatcagggcattcttccctgatgtgagggcactgataggaaatctttaatggtccctgctgcatgaaactgcttccattgcaccagggtagccctgacccctatttggtcccccacatctccttgtaacttacccacactcctccctccttctctgtgcaggtttcacccatcgaagctctatgcccaccaccagcagtgagtattcaactcatgtccacatgcccatgatcctacaccaagcaaagcaggagctgcccctcctcataaacccataagtcctcctcttgagcaaagtagctgggaaggcagaagttattcaagctcccctctgccccagtttcaaagacagactcagctcaagcccacatgcagcaaaccctataaaagtctcacctcttggcatttctgccatggtaatgctttctgctctcactaatgaggacttctcctcagctcctgggacctccacagtggatgtgggaacctcagggactccatcctccagccccagccccacgagtaagtaccagtcaatggcatctctattagagcatgctatctctgtcatttttactcagatgaagatggaaaatcatagcaaatctactgatagtgagtggaccaacgaaatttgttggccacctagtgtgtaccagatcctagagatacaggagggaaaacaaaaccaatacaaaatttctgctctcagtgagcttgtattcttgtcatgatgatgatgttggtggtggtgctgttgatgacgatgatgatgatgatgatgatgatgatgctggtgatactgttgatggtgatagtgatgttgatgacaatgatgatgatgatgatgttgaagaaaatgatgctggtgatggtggtgggggttattatggtaataatgatatgttgagtgtgacgatgatggtggtggtgttgatgatgatgatgattattatgctagtgacattgatgatggtaatggtgatatcaacgacagtgacaatgatggtgatgaggatgatgtcggtgatggtggtggggttatgatggtaatgatatgttgaatgtgatgatggtgatgatgatatttgtggttcatgatggggattgtcatggtggtgctggtggtacttgtgatgacaataatgataataatgatgacaatgatagtgatgatggtgatggtgataataaagataacagatatcaccttacaatattgagcactaaatatgtaccaagagctatgctcagtatctaactactattatataatctactttagaaaatgaattgtatcatagataagaaaggcgtggaaaatatttattatgtcactcaatttaattgctgcatatggttattacaaagtgctattctctctactttgaacataatgtttatttcacactcccactatagctgctggccctctcctgatgccgttcaccctcaacttcaccatcaccaacctgcagtacgaggaggacatgcgtcgcactggctccaggaagttcaacaccatggagagtgtcctgcagggtctggttagtgtcctgccctccacactctgccctgctcatgatacccagtccctcttacatcatccatgccagggcaatggaagaatatcaaacccaactcacttttgccccaagagatgcaagcctcagccaggagcggtggctcacgcctgtaataccagcatttgggaggccaaggcgggtggatcacctgaggtcaggagtttgtgaccagcctggccaacatagtgaaacctcatccctactaaaatacaaaaattagccaagcatggtggtgcatgcctgtaatcccagctacttgggagggtgaggcaagagaatcacttgaatcaaggaggcagaggttgcagtgagtcaagatcatgccactttactccagcctaggcaaaaaagcgaaactccatctcacaaaaaaaagaaaaaaagagagagatgcaagcctcccccaccaaggccagccctgcccacctcacttctgcctggctcttacataaaacttagccctcctactcactgccctctccctcctccacagctcaagcccttgttcaagaacaccagtgttggccctctgtactctggctgcagattgaccttgctcaggtgagaacttagaatttccagcctggctgccccacttgtactcactccaaaagactttgcactgcttccttgctgcacttcctagggatatcctcaccaaaggtggaattcaggagtcacaggcttcaggatcagtgtgtttcctgacagtaacacccctacactccacctcaacagagagaatctgcatggcccatcatcaggattgagcctctccctttatcatccctctgaattccctccattccctgtgcctccctttcctttacatgttaaattctgtccccaggatttctttcaggacaatcatgccttatccacgtgatttcatcctcatttcgagctcttcactgggctcaagtccggctccccgtcccgtccatgaaagtgtcagtttcatcttgtcactgtatccgtgactccactcacagtcctcagcaagccaatagtccatgcactaagagtcgatgtggcttctcacctctttcccaggtttctcatttctctggtccttgctgtccttccctcagcaatcgcaagacccttcctagataaacttttcattgtgatttttcccactgaccctccccaggcccgagaaagatggggcagccactggagtggatgccatctgcacccaccgccttgaccccaaaagccctggactcaacagggagcagctgtactgggagctaagcaaactgaccaatgacattgaagagctgggcccctacaccctggacaggaacagtctctatgtcaatggtgagtggctgtgatgtggttgaaatctcttcccccttgctgggcagcctctaatctctaactagagatcacactccctgcctggcctttgaaaattctgtcatgtgctctacatgggatgactaaggtctggacttcatggtttccttaccatcatggactgtgttccctcagggcattctttcctgatgtgaggatgctgatagaaaatcttcaattgtccctgtaccatgaaactcggttcattgcaccagggtagcattgacctccatttggtcccccacctctccttgtctcttacccactctcctccctccttctctatgcaggtttcacccatcagagctctgtgtccaccaccagcagtgagtattcaactcatatccacatgcctcggttcctacaccaagaggagcaggagctggcccctcctcataaacccattaagtcctcttcataagcaaaggatttaggagggcagaagttatttaagtgtccctctgcccagctcaagagaccgacccagctcaagctacacatgcaacaaaccccataaatagtctcccctcttgccatttctgccaagagagtgctttatgctttcactgatgagaacttttcctcagctcctgggacctccacagtggatctcagaacctcagggactccatcctccctctccagccccacaagtaagtatcagtcaatgacatctctatgagagcatacctgattagtgtaaacatctctgtcattttcactcaaataaagatggaaaatcatagtaaatctagtgatactgagtggacaaatttgtttgtttgttttttctcatccttttcactttttttattatactttaagttttagggtacatgtgcacaatgtgcagtttagttacacatgtatacatgtgccatgctggtgtgctgcacccatttgctcgtcatttagcattaagtatatgtcctatgcgatccaagcccacgcgccgcaccacgtgcaacagtttcacagattggatggtccgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaccatcaccaacctgcagtatgaggaggacatgcatcgccctggatctaggaagttcaacaccacagagagggtcctgcagggtctggttagcaccctgccctcttcactctcccccgccctggatgccgagcccctcatacaacattcatgccagggcaatggaagaatatcgcaccaaccttgccctcatccccagagatgcaagcctcacccactgaggccagccactctcatgggtgtctgccccacccacctcacttttgtccccacacagggaccttagccctcctacttacctctctctccctcccccacagcttagtcccatattcaagaacaccagtgttggccctctgtactctggctgcagactgacctctctcaggtgagaccttagaagatccagcctggctgccccagttgttcccactccagtagattttgctctgcttccttgctgcacctcctagggatatcctcaccaaaaggggaattcaggagtcactggcttctggaccaatgtgtttcctgatagtaacactcccacacctcacctcaacagggagaatctgcatggtccatcatcaggattgagcctctatcctgatcatccctcagaattccctgcccctccctttcatttaggtgttaaattctgtccccagaatttctctcaagacaatcatgcctcatccaagtgctttcatccctgtttctagctcttcactggtctcaagtctgggctctcctgtccccatgctatgagaatgcaggtttcaccttgcacttttataagcatggttgtatctgtgactctgtgcacagtcccaagcaagccagtagtccatgcactcagagaatctaagtgtagcttctcacctctttcccaggtttctcatttcctctggttctttactgtctttccatcagcagtctcaggacacaacctaagtaatcttttcatagtcattctccccacctaccttccccaggtctgagaaggatggagcagccactggagtggatgccatctgcatccatcatcttgaccccaaaagccctggactcaacagagagcggctgtactgggagctgagccgactgaccaatggcatcaaagagctgggcccctacaccctggacaggaacagtctctatgtcaatggtgagcagctgtgatgtggttggagtcttttccttctagagtctggaaagaatctaatctgtggcttgaagtcacactccctgcctggccattgaatattctgtcatgtggtgtagatgggatgacaaagttctggacttcacagtttcttcattgtcgtgaactgtgttccctcagggcactcttccctgttgtgaggatactgataggaattctttaatggccccagtcccatgaaactcattgtcccatgaaactcatttaattgcattgggattgccatgaccttattgtgtccctcgtatctccttaacgcttaccaagtctcctccctccttctctatgcaggtttcacccatcggacctctgtgcccaccaccagcagtgagtattcaactcatgtccacatgcccctgatcctacattaagtggagcaggagctggcccctcctcttaaacccataagtcctcctcttgagcaaaggagctgggaaggcagaagttattgaagctcccttccacctagctccaaagacaggcccagctcatgcccgtatgcagcagacctcataatagtctaccttcttgccatttctgccatgagattattttctgctttcactgatgagcactttttctcagctcctgggacctccacagtggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttcaattcccactacagctgctggccctctcctggtgctgttcaccctcaacttcaccatcaccaacctgaagtatgaggaggacatgcatcgccctggctccaggaagttcaacaccactgagagggtcctgcagactctggttagtgcccttccctcctcactctgcccagccccagatatccagtcccttctacatcatccatgccagggtgatgaaagaagatagcaacaacttccccccttccccccaagagatgcaagccccacccacagagaccagtcctgcttattggtgcctgctccacccacctcacatctgccccgacacacacacaccttagccccactactcacctccctctccctcctctacagcttggtcctatgttcaagaacaccagtgttggccttctgtactctggctgcagactgaccttgctcaggtgagactttagaagagccagcctgggtgcccaaacttgttcccactctaaaagactttgcactgcttccttgctgcacttcctaggtatatcttcaccacaaggggaattcaggagtcattggcttgagaaccagttgtttcctgatagtaacacccccatgccccaactcaacatgcaaaatcttcatggttcatcatcaggattgagacactaccctgattacccatctgaattccctcctttccctgacccctccctttcatttaggtgttaaattctgtccccaggatttctctcaagataaccatgcctcatccacatacatgcatccgcctttcaagctcatcactagtctgaagctctgggttctcctgttcccatgccatgagaatgcaggtttcaccttgcacttttataaaaattattatatccatgactctgcttgcagtcccagaccaagatagtggtctatgtactcagataatctaagtgcagattctcacctctttcccagatttctcatttcctctggttccttgatatgtttccctcagcaatctcaagacaagtcctaggcaatcttttcattgtcattccccctcctaccttcctcaggtccgagaaggatggagcagccactggagtggatgccatctgcacccaccgtcttgaccccaaaagccctggagtggacagggagcagctatactgggagctgagccagctgaccaatggcatcaaagagctgggcccctacaccctggacaggaacagtctctatgtcaatggtgagcagctgtgatatggtaggggtctcttcctcctggctgtgcaaccatctaatctctggcttgggggcacactccctgcctggccattgaaaattctgtcacgtgctctacatgggatgactaagttctggacttcatggtttctttgttatcatgagaggcattccctctgggcactcttccctgttgtgaggatgctgataggaaatctttaatgacccctgtcccatgaaactcatttaattgcaccagggtagtcctgaactctatcgcgtcccccacatctccttaacccttacccagtctcctccctccttctctatgcaggtttcacccattggatccctgtgcccaccagcagcagtgagtattcaactcatgtccatgatgcccctgatcctacatcaagtggagcaagagctggcccctcctctttaacccataagtcctcctcttgagcaaatgagctgggaaggcagaagttactcaagctcccctctgccccagctccaaagacagacccagctcaagcccacatgcagcagacctcataatagtctatcttcttgccatttctgccatgagagtgctttctgctttcactgatgaggacttttttcagctcctgggacctccacagtggaccttgggtcagggactccatcctccctccccagccccacaagtaagtaccagccaatggtatctgtattagatcatgcctgatgaatgcaaacatctgtgccattttcagtcaaatgaaaatggaaaatcataataaatctagtgatactgagtgaaccaaaaaaaatgtattggccacctacagtgtaccagaccctagggatatagcaaggaaaatagaaccaataaaaacatctctgccctcagtgagcttgtgttcatgtgatgatatgatggtggtggtggtggtaatagtaataatgacatattcagtttgatgataatttatgattatggtgttgctgttgatgatggtggtggtgatgttactgacaatgatggtgacggatctttgaggatattgtccgtgatggtcgtgaagattatgatgataatgatgatgtgttaagtgtgatgatgatgatgatctgtggtgatgctgtttaggatgctgttccgtggtaccgatgatattgatgttggtcgtggttatgttgtatgacaatgacaatgatggtgatgaggataatcgccagtgatggtgtgggtttatgatgatgatgatgtgttgaatgtggtgatgataatgttcgtggtggtcgtgatgggcattactatggcagtgatggtcataataatgatggtgatggtgacaatgatagcaaggatgatgatggcaataaagatagtacataacatcagacaatattgagctctgaatatgcaccacgaggagtgctcagcatctaaatactattatataatatatttttgtaaaaataaattgtattgttttaggcaagggaagcatggtaaatattttgtcactcaatttaaattctgcatatgtttaaagataagtctattgcaaactcctattttctctactttggacatagtgtttgtttcccacctccactacagctgctggccctctcctggtgccattcaccctcaacttcaccatcaccaacctgcagtacgaggaggacatgcatcacccaggctccaggaagttcaacaccacggagcgggtcctgcagggtctggttagtgctccaccctcctcactccgccccaccccagagagtcagtacctcctacatcatccatgccaggtgatggaacaagatcatacccacctcacccttgccccaagagatgcaagccatgcccattgaaaccagccccactcactgatgcctgttactgccccacctgacttctgccctacacacccacacacgcaacttagccctcctactcatctccttctccctcctccacagcttggtcccatgttcaagaacaccagtgtcggccttctgtactctggctgcagactgaccttgctcaggtgagaccttagaagatcaagcttggctgccccacttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttagtctacttttgaacactgtttatttcccatcttcactatagccgccagccctctcctggtgctattcacaattaacttcaccatcactaacctgcggtatgaggagaacatgcatcagcctggctctagaaagtttaacaccacggagagagtccttcagggtctggtaagagccccacatacctcattctaccgccactcaccatgtttagtcctgcccacctcacctattgcagagcatggaagatctcatctacctcatcttgcccccagatatgcataccccaaccactgatgccagccccaccaactgttgccagccctgcccacctcccttctaccacacccctatgacttcagtcctcccactcacctccctctccctcctccacagctcaggcctgtgttcaagaacaccagtgttggccctctgtactctggctgcagactgaccttgctcaggtgagaactgagaacagccagtctgactgatctgagcagtttgacctgcttcccttctgcactccctggagatgtccgcagccaggtggaatccaggaggcagtggctctaagaccaatgtgcttcctgttcccaccacctcccacctcaactgagagatgcagagcccatcagcaggactgagcttctaccttggtcatccctctgaattccctcctttcccctacctgcctttccacaagtggttcaattctgttcccaggatttctcccaagaaaaacatgcctcgtccacttgctttcatccccaaacctagctcttcacctgtctcaagtatgagttctccttaccccatgctacaagaatgcagtttccactttgcaattttataaaaatccttgcatccatgattctgctcatagttgctaagagtcagtgcactcagagaatggaagtatggcttctcacttctctaccaggcttctcatttcctctggccccctcctgtcctgccctgtgggatctcagaacccctccctaggcaatccgtgtattgtctttccccaatcttgccctccccaggcccaagaaggatggggcagccaccaaagtggatgccatctgcacttaccgccctgatcccaaaagccctggactggacagagagcagctatactgggagctgagccagctgacccacagcatcactgagctgggcccctacacactggacagggacagtctctatgtcaatggtgagtagttgtgatgtggttggagtctcttcctccttgctgggcagcctctactctctgccttgaggtcacgctccctgcctggctattgaatgctcatccatgttgtctgtatgtgatggctgaggttggaacttcatggtttctatttcatcttggactgagttcatcctcaggatctgctttctggatctgagggtgctgatagagaatcttcaatggttcgtgttctgggaaattccttccattgcaccagggtaccctgacccctatatagttccccaccactcccttaacccttacccaccctcttccctccctctctatgcaggtttcacacagcggagctctgtgcccaccactagcagtgagtatccactgatttccagtgctcctgatcctacatcatgcagggcaagaactgacccctcctcacatgcccctatgtcctctatgagcaaaggagctgggacagcacaagttactccctttcccttctggcccaagtctcttcagagagagacccagctcaagccccacatgcagcaaggtccataaatactcctacctgctggcatttctgccatgagagggttcaacactttcactaatgaggccttctcctcagttcctgggacccccacagtggacctgggaacatctgggactccagtttctaaacctggtccctcgggtaagtacaaatcaatcgcatctctgttagagcatgcctgatgactgtcaacatctctgccattttcacttaaataaagataaaaaatcctagtgaatctacggatgaggagtcatccagcaaacttaattgagtgcctagtttctgcagggctctagggataagaaaggggacacaaaacagttaaaaatatctgctgcaagaaagcttattttattgtgagggtgatgggagttggtggtggtgaagttactggagatgatgacaataagaatggtgatgctagtgatgatgatggtgataaggatgataattatgaagatggtggtggtgatgatgatgatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgccagccctctcctggtgctattcactctcaacttcaccatcaccaacctgcggtatgaggagaacatgcagcaccctggctccaggaagttcaacaccacggagagggtccttcagggcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaggtccctgttcaagagcaccagtgttggccctctgtactctggctgcagactgactttgctcaggnnnnnnnnnnnnnnnnnnnnnnnnnnnnnnnnnnnnnnnagaattcagtcgacctaccggctttgatgattgctcagttgaacttagaaatgcactgtctgcccaatggtccagtctcatgagtgtgactcttttctgcctctcttgggtatctgatcaagatggactcaggaaaagtgctccagataactgtctccaatataacactgcccctgccatcacacccaaatgactggaagtttcacagggtcatcagcagggattggacttccaccccggccatccctctgaattttccctcttttctccccacctcccttgcccttaggtgttaaaattctctaactaagatttctctcaagacaaatgtgcctcattcacttgtttaattcccaattccagcttgtcacctgtctcaagtctaggctgtcctgtccccatgccatgagaatgcaagaaccacactgaaatgttagaaaaattcttttatccacaagtatgctcaccgtcccaagctggacagtagtcagtgcactcagagaatctaagtgtggcttctcatctgtgtaccaggcttctcatttcctgtgggcccttcttgtccttccctccgcaatcttgggactcctccctagacaaaactttattattattcccctcacctgccctctccaggcctgaaaaggatgggacagccactggagtggatgccatctgcacccaccaccctgaccccaaaagccctaggctggacagagagcagctgtattgggagctgagccagctgacccacaatatcactgagctgggcccctatgccctggacaacgacagcctctttgtcaatggtgagcaattgtgatgtggttggagtttcttcttccttgctgagcaggcctctactctctgtcttgaggtcactctccctgcctggccactggtcttggccatgttgtctgtatttgatgattgatatgaacttcaccgtttcttcttcatcttgtactggagaccttcatcctcaggaccttcttccctgatctgagtgtacttgtatagaatcctcaaagcccatgttccctgaaactccttcaattgcaccatggtagcactgaccccttttggtcccccaccttnnnnnnnnnnnnnnnnnnnnnnnnnnnnnnnnnnnnnnnnnnnnnnnnttcactcatcggagctctgtgtccaccaccagcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgggacccccacagtgtatctgggagcatctaagactccagcctcgatatttggcccttcannnnnnnnnnnnnnnnnnnnnnnnnnnnnnnnnngactccagcctcgatatttggcccttcaggtaagtaccagtcaatggcacctctattagagtatgcatgatgagtgtcaacatctctgtccttttcactcaaataagattaaaaatcatagcaaattgtacgtgatgatgagtcacccaacaaacttctttgagtacccactctctgccaggccctagagataaggcagggaacacaaaagaggtaaaaatctctgccctcagagagcttcttttattttgaggatgatgtgggatagtggtgatgatgatgttgctggagatgattacaataatgatggtgatgcttatgaccatgatgtgatgatgatggtgattatgaagatgatgatgatgatattgatgatggtagtggttttgacagtaatgatgatgtgatgatgatgatgatagtggtggtggtgattatgggaaggatgacagtggtggtggtgatggtggtggttgtggtggtgattgacaatgtggtggtgatattgacaatgaggatgatgatgatagtggtggtggttatgatggttaaggatgatgtgatgatggtgttggtgatcacggtactagtggtggtgatgtggaccgtcatggttgtggttgtggtggtgatggtggtgatcatgatgataatgaggatgatggtggtgattgtcatgatggtaaggatgaaacagtgatggtgttggtgaccatgttcctggtggtgatggtgcaggtgatgatgtggatgatgatggtgatggtggtggagatgatagggattatgaatatggttcgggtctctgactggtggtggtgatgacaataatgaaaatgatggtcacagtgttggtgatgatgatggtggtgataacaaaggtaatagatagtgtctagtattatggaacacagaacatcaccaaaggttatgctcagcatctaactattattatttagcatgctctatgaaaaactttgatcgttatagtcaagggaggcatgaaaaccttctattttatcactctctttaaatctggttgcatatgtttagaaataaatctattacaaactcttaaatgttctctacttttgaacatagtgtttatttcccacctccactacagctgccagccatctcctgatactattcaccctcaacttcaccatcactaacctgcggtatgaggagaacatgtggcctggctccaggaagttcaacactacagagagggtccttcagggcctggtgagagccctgcccacctcactctgccctgcccaccttgtcttgttccacctacgtcacccattccaaggcatggaagaagatctcacccacctcccctcacctgagagatagccccgccccctgattacagccccttccaccttacatcttcctcacttctatgtcctcagccatcttactcacctccctcttcctcctccacaggctaaggcccttgttcaagaacaccagtgttggccctctgtactctggctgcaggctgaccttgctcaggtgagaactgagaataaccagtctggctaccccaagtgttcccaggcccaaggagtttcatcagctttcttccttccctccctatggaagtcctcagcacaagtggaattcaggcgttggtggctccaggatgaacatatctgctgatcctaccacctcccccatcaatcgagagaatttgcagggcccatcagccagatcaggcttctactttggtcatccttctgaatttcttacttctccctacctccctctccttcaggtgttaaattctcttccaaggtttctctcaagataaacatcccccatccacttgctttcatccccaattccagctcttaatatttctcaagtctgggctctcctgtccccataccatgagaatgcaattttataaaattcttgtattcctgactctactcacattcccaggctgcctggaagttggtgcattcagagaatcttagtatggcttctcacctgtctaccaggattctcatttcctctgtccccttcctgtcctgcccccaggaatctcaggatgcctccccataggcaatctatttaatgtcatcccccttatctgccctccctaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtgagcggctgtgatgtggttggagattcttcctctttgctggacagcttcttactctctgacttgaggtcacactccctgactggccattgacgtcttggctatgttgtctgtatgtgatgactgatgtctgaacttcatagtttcttcatcttggactgagttcatcctcagtaccttcttccctgatctgagggtactgatagagaatcttcaaaggcccctgttccttgaaacttcttccattccactagggtatctgtgacccctatttgattccccacctctcccttaacccttacccactctcctccctccttctctgtgcaggtttcacccatcggagctctgtacccaccaccagcagtgagtattcaaccgatgctccagtagccccaattatacaccaagcagggcaggagctgtcctgtcttcctatgcccctatgtcctcttcataaaggaaggggctgggagggcacaagttattccctttcccttctggccagctccagagagagacccagctcaggcccgatatgcagcaaggcctgtaaatagttttatttgctgacctttctgccatgagaggcttggatgcttcccctgaagagggtttctctgtagctcttgggactaccacagtggacctgggaaactctggggatccaccccttctactggtcccttgaataagtaccagccaatggcacctctgttagagcatggctgatgagtgtaaacatctcttccattattcagtcaaataaagatggaaattctttataaatctagtgatgatgagccaaccaacaaactttattgagcattgtgacaagccctggggctctgccaaatcctggggatatggcatggatcatgaaacaattaataatctctcctctcagagagctatttttatgatgatactgatggtggcaatgatgatgatgttgatggtgattatgaccatgatgacaatggtgatggtggtggtgatgatggtaatgatgatgatggtgatgttggtaatgatggtggtgattatgacaataatgatggtgatggtgacagggatggtgatgattatgatggtggtggtgataacaaagttaatggataatatatgaacttattggctactgaatatgcaccaaagtgctatgctcagtgtttaactagtactatttaatatgatttctaaaaaaaatcttgaattattataggcagaagaatcatgggaaccttttattttgtcactcactttaagtcctattgcatattttttaagtcaattgcaaacacagtttctctgctttgaacattgtgtttatatccagtcaccccaatagtgcataaacctgctgattggagcaactgtgtcttactcccttgtgcttccctagtatctgcttcaggaccttgtacatggtagatcgacagatttagatctacaggaaaatatggattttcccagggaaggaaggaatgaagtatgctttcttataatgtatggaaactttcctcttctgccttggttcaactttagtgtctgccagagtttacactggaaaactatatggcatctgctccactccctcatccatgacagacatcattaattgattgcagcattcatggcagacatcaccaattgataatagcattcattttctctcagttcaaaacagcttcagaatggttaccaaaaaaaaaaaattcagtcgctaccaattcaattggagctgactcaggattatgggacagaattcaagagagttaggttccttgatgatgtgtagtggctatttgttttccggtccaggctaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgtgcggcaaagttcaggggccccaaaaatttctgtgccccaatcatggcggacctaggtttaggcacaaattccagggattaagtccctggagatgttatggcttttggttttcctagaaaggctcagctcaggctcagcttggtcatgctgatatcctttcttccacttggtcgatttggctgttgatacttatgtatgcttcacgaagtttttgtgctgtgtttttcagctccatcggttggtttatgttcctctctaaactggttattctagttagcaattcctttaacctttcatcaaggtgcttagctttgcattgcattagaacatgctcctttagctcatcgtacttttttattgcccatcttctgaagcctacttctgtcaattcatccatctgatcctccatccagttctgcacccttaatggagagatgttgcggtcatttggaggaaaagaggcactctggccttttgggttttcagcatttttttgttgattatttcccatcttcaggagttttagtttcaggctttgaggctgctgatccttggatggggtttttatgggggtcttttggttgttgttgttgatgatgatgatgttattgtcactttctgcttgtttttctttcaatagtcaggtccctcttctgtagggctgctgcagtttgctaggggttcacttcaggccctattcatctgattcgctcccatgtctggaggtgtcactcaaggaggcttggagagcagcgaacataggtgcctgcttcttctgggacctctgacctcgagggacaccaacctgatgccagtaggatcgctcctgtgtagggtgtctgacaactattgttggagggtttcgcccagttgactggcatggagagcaggacccatttaatgaagcactttgtcccctggtggagagggggttcttcactggggggaaaccacatgtctgggctgcttggattcctcagaactaccagaggagaggctaagtctgctggtccacagagactacagccatccctcccactaggggcccaagcccagggagtccaaattctgtctctgagcctctggctggagtctttggagatcctgcaaggaagctctgcccactgaggaaggatgggtcagggttagccctgaagaggcactctggctgcagactgccacagccggtgtgttgggctgtggggacaagtcttgggaccaagccgtccagcctacccggctctagcaggggaaaagtacagcctggagctattgaaaggggtgccgcccttcccccgcccagggagcttagcgtgttaggcagttgtgagtccagtgctggctgtcgccccttccccaaggaacaaaaaagacttagcaggcagccgcagccagtgctggtcgcccctcccccggggagttccgtaggcttaggcagattccagctgtaagaatctgcgtgttctggggttgggacactaggtcccagtggcatgggttcgcgagtgagatcttccaatctgtgagttgcacagttccgtggaaaaagcacagtttccccctcttgggtagcccgctcactcaccacctcccttggctggaaggagggggttccccttccccgtgtgtctctcaggtgggccaccacaccacactgctcttccttctctctgtgggtcactgccagccttctagtcaattttgatgagggaacctggacattttggttgccaggaaggatcacacacttattacagtttttttcaatgtgagcctctgagcgctgctgcttatagtcgaccatcttggcccccagagtcacacatctgttattttttgatgttttgattgtggcaattcttgcagaagtaaggtggtatcaccttatggttttgatttccctggtcattagtgatgttgaacatttttttcatatgttcattagccatttgtatatattctttcaacaactgtctatttatgtccttagcccactttttgatgggattgtttttttcttgccaatttgtttgagttcgttgtagattctagatattagtcctttgttggatatatagattgtgaagattttctcccactctgtgggttgtctgtttactctactgactgtgaaggaaaagtcaatttcttatacgaatttgtctcactcctacttccaaatgagatcctggggttttttttttctgttaatccttcacaatacttctcccacttttttgaactcatttgtttatattctgttgtctgcttctcttttataggaatgtgacttcttatgggctttctctattataccacatatgggtttttgttttgttttgttttgttttgttttgtttttgtcctcggatccattctccaacctcctccagccttcccgtgctctgtgggatagacgtctgactcatgaaaactacatttcccaggctcccatgctaactagcttcctgttaggttcagccaataggaggcattggtgggacaatggtgggcggggctatggaagggccagagtatttctgtaccccgcccccctgctccccttccaatgttcctggagcggtgtaggaccaatactgtatatatggaaggaaggcaaggtggatagattggaaggaagaagtgacagatggaaagaagaagtgataaatggcaagcgaggcaagggagcagaggatggatgagtggattgcaagaaagaaaaaaatggatgaaatataaaaggagcaggacagatggataagtagatggaagtaagaaaagactggtgtaagaaaggaacgattgatgatggatgatgaatggatcagtggtgattgggtgaagggatgaatggatggatggacagatggatgaacagatgggtgggtggatagatggatggatggataaaatgggtaggtggatggatggatggatggacagatgggtgggtaggtggatggatggatagatggatggataagtgaatggatggatggatggatggatggataaatggatggatgggtgaaaggaaggaaagaagtgagagaaggaagaggaaggatagacagatgttagaaggtacaaatgaaaggaaggaagccagcaagaaagaaaggatgcattaatagaatgaaagatggaagggaagaagaaaggatggaaagagagaaggaagaatgaacagaaggaagttcaagagtggtgaaaagaagaaaggcagggagagaaggagaagtaaacttttcttctagagatttgtcttaaaccttagcttggctggacactgtggttcacgcctgtaatcccagcactttgggaggccgaggcgggtggatcatgaggtcaggagatcaagaccatcctggctaacacggtgaaaccctgtctctactaaaaatacaaaaaaaatttagtcaggtgtggtggtgcatgcctgtggtcccagctactcaggaggctgaggcaggagaatggcataaaacctgggaggcagagcttgcagtgagccaagatcacaccactgcactctagcctgggcgacaaagtgagactctgtctcaaacaaaaacaaaacaaaaaaacaaaaacaaaaaacaaaaccaaaccaaaacaaaaaaaaaaaccttaactcatactttcataaagttccacacacagggagtgattagaaagcatttgctgatatattttatataataaacatgtacaccatattgacctgtgtgcccagcagtgcttacatgatttacaatgattaacttgtttaagcttcataacaacggttgaggcaggaaacatcattgtgaaccattgtcatctcattttacagatgagtaaactgaagtgctgagaggttggttatggctgcaaagattgttggccatgttaaccaatgcatagaagattagcatacctggttgtgagtgcaggagagagagagaaatgggagaaaggcagagaaggatcgatggggagagaggaagagagagagagagaataaattttttaaaaatgtctagagtcatgacttccgcatcagtgtggtaatatgcagcctttaccctgggaaagatcagaaccattggtactttttacagaatcttcccttcctgcatttgggtagaaggaccccatctggacatcccaaatcattaagcacacccttactggctgctggagttgtctccattaaaagtcaccgttgggtttattaagaggcggacacagggtccttagaacacactgcccccacctgtcccacaccaccccccacccacccatcatcctccccaagagcttcatctctctctctcttccccctgccctagccggggtggtcagcgaggagccattcacactgaacttcaccatcaacaacctgcgctacatggcggacatgggccaacccggctccctcaagttcaacatcacagacaacgtcatgcagcacctggtgagaggcctgcctcccgctgcagccctgccatgcccatcctagggctgttgcctgcctgcctctgaccaacccaagctcccttctccctctgcagctcagtcctttgttccagaggagcagcctgggtgcacggtacacaggctgcagggtcatcgcactaaggtgagaaactcccccacccacagcgcaccaccaagaacttagagttctgactgggaggtccctcttgggttggggtgggctacatatttttttaaatctttttatctttcctttttttttttttgagatgaagtttcgctctcgttgcccaggctagagtgcaatggcacgatcttggctcactgcaacctctgcctcccgggttcaagtgattatcctgcctcagcctccccagtagctgggattacaggcaggcaccaccatgcctggctaattgttttgtatttttagtagagatggggtgtctccatgttgatcaggctggtcttgaactcctgacttcaggtgatccaccctcctcagcctcccaaagtgctgggattacaggcgtgagccaccatatctggccccattctttttttttaaatgaatttaaggagtgcaaatgcagtttttgttacatgcatatattccatagtgaagtctgcagacagtagacttccagacagtagcttctggtgtatcacccgaatagtgtacattgtacttattaagtgaggttccccacccttctcccactctcccacctttctgagtatccagtgtctattattccacactccaggtccatgctctcacgtataagtgagaacgtatggtattccaccatgagctaatggacatggagtccattggctcccacttataagtgagagcatgcggtatttgactatttctgagtttcacttaagataatggactcccattccatccatgttgctgcaaaatacatgatttcactctttttatggctgaatagtatttcgtggtatatatatataccacattttctttatccagtcttctactgatggacacttaggttgggtccatacctttgctgttgaaatagtgctgcaataaacatacacgtgcaggtgtctttcttatataaatgatttctttttttctttccttttttttgatataacgaatttcttttatttgggttaaatcccccaatagtgggattgnnnnnnnnnnnnnnnnnnnnnnnnnnnnnnnnnnnnnnnnnnnnnnnnnnnnnnnnnnnnnnnnnnnnnnnnnnnnnnnnnnntgacctgtccgtattgatatataaaatgctgcatttaaagtgtacaacttgatattttggtatacattgttaaatcatggccacatttcagctaattaatatatctattatctctacatagttatcatgtttgtaccctttgaccagcatcaccccatttgctcctcctcccagcccctggcaaccaccatcctactctctgcttctatgagtctgacaattttagattccacctataagttagattatgcggtatttgtctttctgtgcctggcttatttcacttagcctaatgtcctccagctccatctatgttatcccaagtggcaggattttcatctttcttatatatttcattgtatatgtgtatgccacattttctttacccattcatccattgaaggtcatttagcttgtttccatatcttggctattttgaatagtgctgcaatgaacataggagtgcagatatctctttaagatactggtttcatttctttctttcttctcttttttttttttctgagacagagtctgactctgtcgctcaagctggagtacagtggtgcaatcttggctcactgcaaactctgcctcctgagttcaagcgattctcgtgcctcaacctcccagggagttttgctcttgctgcccaggctgaagtgcagtggtgcaatcttcactcaccacaacctgtgcctcccgggttcaagcgattctcgtgcctcagcctcccaggtagcaaggattacaggcgcccaacaccacaccaggctaaatttttttgcatttttagtagagacggggttttgccatgttggccaggctggtctcaaattcctggcctcaagtgatccacctgcctcagcctcctgaagtgctgggattttacaggcatgaaccaccacacatggcctcatttcttttagatatatatgggttgagctattctcagagggtccttttctgcatctatttaagatcacattttttttatattgtggcaaaaatacatgtaacataaaatctgccattttaaccatttttaaatgtacaattcagtgacattgattatattcacaatgtcatacagccatcaccactatttatttctaatacttttccattgggtagatccccaacagtgggattgctgggtcaaatggtagttctgattttttttttttgttttttgagaaatctccatactgtttttcatttgaggttgtactaatttacattcccaccaacagtgtataagagtttcctaggccgggcatggtggcttatgcctgtaatcccagcactttgcgaggcccaggtgggtggatcatgaggtcaggagatcgagaccaccctggctaacatggtgaaaccccgtctctactaaaaatgcaaaaaattagccgggcgtggtggcgggtgcctgtagtcccagctactggagaggctgaggcaggagaatggcatgaaccctgaaggcggggcttgcagtgagctgagatcgcaccactgcacacttcaacctaggcgacagagcgagactccatctcaaaaaaaaaaaaaaaaaaaaaggtttcctttcagtgcatccttgccaacttgagttttctgggttggtttgcactctcatggtatttactagatacttctccatttatatttttactcaacccatgcccataacaccactcctctaccattcccaccaaccatgtataagagttccttttcttgcatccttgccaacttgacttctttgggtcagtttgcactctcttggtatttactatttacttctccatttatatttttagtcaactgatgcccatggcaccgctcctctgaggcaggtgctgggtactagagtgataagacagatgctgtccctgccctcacccagtggagaagaacagatgctaaacaggaacataaatatctaagtaaaatggcttcaaatggagtaaagtgatatgaaacataaataaatagcaagtgatgggtagagcaactttacccaggatgaatcttgggctgtgtcccaaatggccatgaaaactgttccaggcagggagaacagcatgagaaaaggtcttgaggtgcaaatgagcttggcatgttctatgaacagcaaagaggccagtgtggctggagcagagagagagcaagaagaaaagagagaaaggatgagactcaagacatcagcaagtttgaagggccttggaggacttggatttttttttttaagacagctttgttcttgttgcccaggcatgatctcggctcaccacaacctccgcctcctgggttcaaacgattcctctgcctcagcctcccgagtagctgggggtaacaggcatgtgcccaccacacctggctaattttgtatttttagtagaaatggggcttctccatggttggtcaggctggtctcgaactcccgacctcaggtgatccgaccgcctcggcctcccaaagtgctgggattataggtgtgagccactgcacctggcttggattttttttgttctatattgtggtaacatacacatcacattaaattgatcattttagctatatttcccgttcagtggcatcaagcacattcacattattgtgcaaccatcaccactatcatccatctccagaactttctcatcttcccaaactgaaactccatccccatgaaacactcattcctcatccccctcctcaagcctctggcacccaccattctactttctgtctctgtgaatctgatgattctgaggacctcctatgaatggaggaatcatatggtatatgtcctggtttatactgtatggctggcttatttcaccaagcataatgtcctcaaagttcatccatgttgtagcatgtgtcagaattcccttccttttccacttgtatgtaaatgctgtattgtgtttctccattcattaggactttgatttttgcagggagttgtcaaggggtgctgggttctggggcttcaatataataagagtaagctaaactggttcatttcctccttcgtggagaccatgttctggtaggaacaggaacaaataatttatgattacatagagggtgaccagggcagtgacaggggaagagtggaggattgtgggacccagaggaggctcctgaccttgcctaggaagataggaggaggaagaggaggaggaagaggaggaggaagaggaggaggaggaggaggagggagtcctctaagctgagacctggaggatgaccaggaagttatccaggtaaggagaaatggggagaagcttccagacaaaagtaacagcaattgcaaagatcctgagatgatagataaggtcaggtggagaaagtgcaaactgtcaatgagaccaaaatatggactgtgagttgtgcagtgaccacaagtggagaggtgctaggtggccttcatcccccaaagctgcacctctccctcctcaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggtgagcagctatcagccccatctccctgccccaccccccagcccccactgcagtccaggagggtgtctgtttgccggttctctagggaaagacttggggttcaagtcttggcattaccactggccctcccataaccacaatgcaaggttggactttgattaatcccattttacagatgaagaaactgaggcttagacaggctaagcaatttaccttgacagtggtggaaccaggatatgaactccacttgtcagcattcggtgctatgatccactccacatgtttaactcacagaagagtcttcctggtgggggcacttgggggacaaaaaacacatttccggctgtgagcagtggctcacacctgtaatcccagcactttgggaggccaaggcgggcggatcacaaggtcaagagattgagaccaccctggacaacatagtgaaaccctgtctctactaaaaatacaaaaattagctgggtgtggtggcgcacgcctgtagtcccacctactcgggaggctgaggcaggagaatcgcttgaactcgggaggcagaggttgcagtgagccaagattgcgccattgcactccagtctgggtgacaagagtgaaactctgtctcaaaaaaaaaaaaaacaatttcccctccctgctttcttctcaccattgacgagggatgggcttctctcctacctgaggccccctataccaggaagatctatgggatctaatcttcagcgcacactgggcctcagcattggtctagaactcaggataagatagcatttaagaaggcatcccctaaatggggttctgagaggcaaagcatgaccgtggagaattgacaaaatagctcgcctttcatcccctccaccgccaacccaagaacagtgcttatcatcatgaccccatgaggtgggcaccccatatcacttatatgaggtacctttaggtaggtaccgggatgtggagagacatcctgggctttcattactcttattttagcaaagagggaatctgaggcacagagaagggaagggacttgcccatgcccacagcgagtttttggctagtatgggtcttgatgttctttctgggtccgtnnnnnnnnnnnnnnnnnnnnnnnnnnnnnnnnnnnnnnnnnnnnnnnnnnnnnnnnnnnnnnnnnnnnttcctgcgtgggagatgtgtggatttgatttgtatctggaaagatgattttttattggtgacaaagcagttaaagttaatcttcacagttgtgcggagagtgaccacgcgagttagtcttatccttatttttttgatcatcccgctacacaagacaaagcgaaccgcacaggcaacatcagcaggccccattggtgtgttcccctctatgggtccatgtgttctcatcattagctcccacgtataaagtgagaagatggcagtattggttttctgttcctgcattagtttggtaaggataatgacctccagctccaaccatgttcctgcaacggacatgatctcattcttttttatagctgcatagtattccatggtgtatatgttcctcatgttctttatccagtctatccttgatgggcatttaagtagattccatgtctttgctattgtgaatagtgcttcagtgaacaggtgtctttatgatagaaaaatttatatgcctttgggcatatatgcagtgatgagattgctgggtcagacggtagttctgtttttagctctttgaggaatcatcctgctgctttctacagtggatgaactaatttacactcccaccaacagtgtataaacactcctttttatctgcaacctcagcagcatggttttatttctctttatggctgaatagtgttccattgtgcatatataccacactttctttatggattcatctgctgatggacatataggttgattccacatctctgctattgtgaatagtgctgtgataaacacacaggtgcgggttgggtcttgatgatctcagttaacatccagtcccttcaacttggctattgcagggagctgttcccccttgtaaactgcacagcttatgtgcttcattttgttccttcatttagatttaccaagcagctactattaaccaggccacaatgtgcctcgcccccaggaacagagataggttacatgtgcatcctgtcctaatgtaatctccaggggggcggagactgttttgttctaccctatattccccaaatgtaaagggagccttgcacatactaagcccttaataaacattcattgggtggaggaatagattggaggaggcctggaaggggaggcgggggttatggatggataggaggatagacttgtgaacacaaaggtagtgagagcctctcattggaggcatgctggagacgtgagtagggaagggtcagtgctaattgaaatatcaggaaattctttctagtggtgaacacatttaagtcaaatattagatgatacataaatgtatccataatctctagatacacaaagggaaaggcatccaggcaggggccccatatggacaaaggcatggagtatctgggacggttccaccacctcctcttacgtgtgacttctttgtttcaaggttacaatgaacctggtctagatgagcctcctacaagtacgtgtctttgaatctagtgcccatttcaatctccatgggtcttggttcaagcttttctcctcattcatgaaggaaggttgccccaaattcgggctggtcccctaggtggtgaggggcattgtctcagtgggaggaagaatgctgagtccttggccctgtttttagacctgcagccatagtcttggctttgtgaattttccatgtccctctgggttggaggaagaagtttgaacaagcattccctacacgggatagaggttgaggtcagatgatgacctctgttagtctgtaccctccttgataagaaaatctcctccaagtgccccagcagaggcttcatggtcaagctgcagactctgctggctactggttttggctaaatttgcccattgcctcatccagtgatccactcgtctatctttccagccatccatttttctatccttccagtcatctctcagacaccacctgtccttccatccatccatccgtccatccatttacccatccatccatccaccccattttcctgaccatttacctcctcgtccttccttccatctgtccttttatccatctattcatccatcacccatcctcctgcccattcacctgcttgtccctcctttcttctgtccttctatacatccatccatccatccatccatccatccacccatccactcatccaccacccacccatccttctgcccactcactcgctagcccctccttccttctgtccttccatccatccatccacccatcttcctgcccattcacctgcttgtccttccttctatctgtcttttatccatctctccatccattctcaccatccatccatccatccttctccctattcactggtttgtctttccttctgtccttccaaccatccacccatctctccattcattctcctcttcattcaccatgtttccttatttctgtctcttccatccatccatctatccagacagacatctcctccccccattctcctccccattcactcaattgtccttccttccatctgtccttttatccatccatccacccatccatccatccatctatccttctccccattcacctgtttgtccttctttctgtccttccaaccatccatccatccatcatccatccatctatccttttccccattcacctgttttgtccttccttctgtccttccaacatccctccatctctccatccatcctcctgcctattcatctgcttgtctttccttccttctgtccttccatccattcatccatctgcccatccacccactcatcctcttgcccattcacctgcttgtccttccttccacctgtccttttatccatccatccatccatccatcttgctcactcctccactcacacaatcactccttccctcagtctcatttatggcccacctgtgaatggttgtcctggcttggaccactgatgaagcccaggggagcttctcccactagtggtgggcttttgtcctctctgatggactgttccttccacagctcccaagccagccaccacattcctgcctcctctgtcagaagccacaacaggtatttggggccatttttcctcctcgaagattagaatagcatttcaatcagacacctgccctcgtggagtcccagattttatgaaataaatagaccatcataatgtcagatgttttggggtgagatacctggcatagttgggaaggaggagggctttctggagaaagtttcacctgaactgagtctttaaggatgactaagagtgattcaggcaaatagggcatgaatagtataactgaaagaggggaatctgtgagcaaagcctcagtggccagaaacagcatagagtatagggagaagtgagagaaatttggtttgcatgaaacataaagcttaacccagagtggatggataagtgagactgaaaggtcagcaggagccagattgggaagggccttgaatgccaagtcaagaaatttgaacttaacactgaaggccatagggagctgtggatggtactagagcaggggcagccatagtgagattgtcatttcagaaagattcttcttgtgttcagtatagagaatgtcctttagacagggcatccagtgagtctgccaggtgctaatcagggtgagagaaaataagacctgaactgggatagggggaggagagagaggatatatgtgatgaatattcagtaaagagaattggtgttacttggaggggagaagacacatagcttctgacttgcgatggccacactcagtttaataatgagcgcagtctgatctagtctcagaccagccctcagttgcagacgtctctcctcccctcctgcagcatggggtaccacctgaagaccctcacactcaacttcaccatctccaatctccagtattcaccagatatgggcaagggctcagctacattcaactccaccgagggggtccttcagcacctggtgagaccctggtcccagcagctcctggtgggataaatcctacccccaacctctgttcctcggcttaccctcttcctccttcctctcaagctcagacccttgttccagaagagcagcatgggccccttctacttgggttgccaactgatctccctcaggtgagaccacttcctggccatttgccagtaacaaccaccccttttgtgaccaccccttcctcagctttcccctgctcctccctccactgctctttacctgcagaggtctcgggacctctctagagtcctcaaatgcctctctccccaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggtgagtgtcaggctgaacttggatttacagtgacttttggggagttggtttctttgtttttgagatggagtctcactctatcacccaggctggagtgcaatggtgcaatcttggctctgcaacagtgattctcctgcctcagcctcccaagtagctgggatttacaggtgcatgccaccacgctcagctaatttttgtatttttagtagagatggggtttcaccatgttgcccaggctggtctcgaactcctgacctcaggtgatccacctgccttggcctcccaaagtgccaggattacaggcatgagccaccatgcccggcccaccatgactattatttgtccctgttgtatgccctttcctctctaaaaaaaatagcccaaggcctggctgggggacacccttccccaaaccaccaaggggagggtctttcccattattttgagtaaatagcatgaaattctttgaccaaattaatgtcataaattgtttgtctctttctccttcacttttgtttccaacttggttgcggtataactatcaaatacaattgtatgtatttaagatgtataatgcagtgatttaatatatgtgtagcttatgaaatgattaccatgatcaaattagttaacactgctttcatgtcacatagttaccgtgtgtctgtgtgcgtctgtgtgagttagagagaaagagaacatttaaggtctaccctcatagaaaatttcaggtttacaatacagtattattaactataatcatcaagctttatactcgatccccagaacttattcatcttgtaactaaaagtttgtattttgtgaccaacatctccccattttctctatcaccacccccatgcccccagcccctgataaccatcatgctactctctgcttctgtaagtttgacttctgatcccacatataagtgagatcatgcagtatttgtttctctctatctggtatatttcacttagcataatgaaccccccccaggtacatccataatgaatttcaattcaaaacccaagtggctgagtcgtggcatcctttgggacaggatagcaggtcccttctatataaggatcctctgtgtcagtggttattaccaggggacaattctgcacttctgccccaccccaccccccaactgggagactctaggcaatatccgaaatcatttttgggtatcacaactcagggagggaaggagggtgcaactggcacctagtgggtcggtagcccattttccagtgcacaggagacaaccaccccagggaatgatccagccccaaatgccaataatttcaagggtgagaaatcctgttgtacatggtctcaaagttcttaggtgggcacaaggctgacatttatcacactttactgtaattacttgttaaatttatctgattcccccttaccctgtgaactcaacaaaattacggtctattatgagtgccactgtaccctcggttcgcagtacatcagcacatcatagtatggaaagaatcattgaatgagtgagcaaattaaagatttgtgtctctgctgtaactcacattcattaattcattcattcagcaaacatatatgggtggctgttctgccccaagccttgtactgggtctggagatagaagacacatttttctgtctctgaaaaactcatactcaagttaacaacaaattacgggcacaacaaagaccccactgctgttattaacagggtactatgggagctgagaggaggagtaaattaaggagggcttcctggaggagggtgttatatacccggccctgtgccgggacacataatgataagacagacttgggcctctgctgtcctggagctccctctcactgggctcttgaagcgtgagcaggagttttgcaggaaatgaaaaggatgcattcctagaagtgggaactgcatagcacatgcaggaaagctcagctcagaagaatctgtgtaatattccatttttccctctctttggggcaactttctgtctaagagctcctgcaatgcccagcgtgtggacctgaaattgattctgacagtaggcaggggactgctgggcaactttggctctgcattttgtgatcaacatttccccaccatatgttgccttttcttcttctctgtggctccaggctatgcaccccagaatttatcaatccggggcgagtaccagataaatttccacattgtcaactggaacctcagtaatccagaccccacatcctcagagtacatcaccctgctgagggacatccaggacaaggtggggcatctctcacccctcccgtcttctctgtcctgtgtgcttctctccctcttctacctgatttctctgttaagtgatcactttaaatgcttcacttcactatgtattctgggttctctctcagtttccaaaagtactctcttgactaccattcccatttcacagatgggcaaactgaggctcagaaaggggcgtggtgtgcctagggtcatacagtgctttaggaacagagttaggatttgaactctggtcccctttgctccaagtcctgtgtttttttccactggcatcagcggcccctccacccccaagaggcctccatctcacccactctccctacccatctttctaggtc

SEQ ID NO: 313 - DNA, 14277 bp, Homo sapiens
  misc_feature (1)..(66): Exon C1
  misc_feature (1802)..(1947): Exon C2
  misc_feature (4198)..(4350): Exon C3
  misc_feature (4679)..(4747): Exon C4
  misc_feature (6811)..(6978): Exon C5
  misc_feature (11232)..(11270): Exon C6
  misc_feature (11594)..(11677): Exon C7
  misc_feature (13375)..(13500): n is a, c, g, or t
  misc_feature (14095)..(14187): Exon C8
accacactctacaaaggcagtcaactacatgacacattccgcttctgcctggtcaccaacttgacgtaagttctgaaggtcataagcagtgaccaagcttgtggctgtgtctctgagcacccttgagctagacgtccccagtggggtacccattctcccctacatccctgtctagctaatcctaccatctcctcccataaatcctcaaggtagggagtgaggattaacctcatggggccaccaactcccagcatacaccttcttttttttctggacacttgggaaaatataactttttgatgtagaactcaaaatattagcccaataataatatttaacatcaaccagcctcctctcatttaattctcacaacagaatctatgagttgagtgcaaaaatcatccctattgtgcagatgggaaaactgagggtcagaaaagtgaacttcccaagaactgtcaaagttgggatttgaacccaggtctctgatgactggatgaaggaatgaagatacctatacttgggaatgaggagggtcgacaggacacgagggctgactttgtatatttctaaacttcaaagattttctgtatttcagctgggaatatggtagaaggttaattggaacaaaaaaatgcaaagcaatgaataagacctcagtatttgctatgcacaacagggtgactgtagtcccacaaataacttcactgtacattgttaaaatataactaaaggtgtatgcttggattgtttgcaacacaaaggatatatgcttgaggggatggataccccatttaccctgatgattattatgcattacatgcttgtatcaaaacatctcatataccccataaatataaaaacacctactatgtaccccaaaaaattaaaaacaaataaaatcaaaagtaggctgggcacagtggctcatgcctgtaatcccagcactttgggaggccagggcaggtggatctcttgagcccagaagttcaagaccagcgagggcaacatagggagtcctagtctctacaaaaaatacaaaaattagccaggcatggtggcacacacctgtagtcccagccactcaggaagctgaggtgggaggatcgcctgagcctaggaggctgtactccagcctgggtgacagagcgagactctatctcaaaaaataaaataaaataataaaaagtagaaatcaagagggaaaatgtgggagaaattgggataattttaacaataccttccaccagagtgatgatgaagaatgcataagtcacttcttagtggtcttgatctataaaaagtgttcaataaatatcgattattgttactgttattgcttctagacgtaattcctggaagcattttttttttttttttttttgagatggagtcatgctctgttgctcaggctggagtgcagtggtatgatctcggctcactacaactgcctcctgggttcaagcaattctcctgcctcagccccccatgtagcagggactacaggcatgcgccaccacacccggtgaagttttgtatttttattagagacagggttttgccatgttggtcaggctggtctcgaactcctgacctcaggcaatttgcctgcctcggcctcccaaagtgctgagattacaggcttgggccactgcatccagccgaaggcctcccattttgatcagaacccttctctagactgagggtgggtgcctctagatcttttgctctttaaagacagcaaccgatgaccctgctgatgctgagtactggctgaattcctgtggtctctgtccctaggatggactccgtgttggtcactgtcaaggcattgttctcctccaatttggaccccagcctggtggagcaagtctttctagataagaccctgaatgcctcattccattggctgggctccacctaccagttggtggacatccatgtgacaggtacaaggtggggtggctggtttcctaactggaagaggtggggttatgaggaaagatggggcttctcggtaccagtggaattggtggaggctctagagagggaaagggaggctttctggagacccatgtaggtgacctctggcagtagatcatccaacgaggcaggaacagaacaccagccattgcatctaagagaatagctatttttacatgtaaaaagaattgtgttgaatgaatgaatcaatagatcatttattttgaatcaatttattgattcattcatttaattaatgaataataaatgattcagtacataattgattaattgatgtaattgagaattgatttaattgattaattgatcaattaaaatgatcaattaaatgaatgaatcagtaaatgaataattcattcattcaataaacaatggaagtaggccgggcatggtggctcacgcctgtaataccagtactttgggaggcccaggcaggcagatcacgaggtcaggagattgagaccatcctggctaacacggtgaaaccctgtctctactaaaaatacaaaaaaaattagccaggcatggtggtggccacctgtagtcgcagctactcgggaggctgaggcaggagaatggcgtgaacccgggaggcagagcttgcagtgagccgagatcgcgccactgcactccagcctgggcgacagatggagactctgtctcaaaaataaataaataaataaaaataaaaaataaataaacaatggaagtaaacacgtactgataacacagtgtgatcattgctatgataagggaatttcaggggcctgtgggagccccaaggaggaacacacaaccttgtcttggaaagttttatgtaggaaggggtgaagaagctgagatctgacagagaatgggacctagccaggggtaatagatggagaattgtgctccatgcatctataacctagaagatagaaagaatatggcatctggccgggtgcggtggctcacgcctgtagtcccagcactttcagaggctgagatgggtggatcacctgaggtcaggagttcaagaccagcctgaccaatatgatgaaaccccatctctgctaaaaatacaaaaattagccaggcatggtggtgcgtgcctgtaatcccagccacttgggaggctgagagaggagaactgcttgaactcgggaggcggaggttgcagtgagccgagattgtgccattgcactcaagcctgggcaaaaagagcaaaactgcatttcaaaaaaaaaaaaagtggcattttggggcaagtttaagaagattggtgtagctggagcatccactttgatactggagaggtgacagttgaagccaaagatgtgggcagagactttgttgggcactggaatggcttggggaggaacatgacacactcatgagttctgctttagaaagaaaatgaaatgaattctgctcatcctctgggtgctgtgtgcagaatggagggtggggggagagaagagcaaaggcaagaagaccctttaggaacaatgatcattagttagaagactctgggtttctcagcacctgcaattgctgactacacccccagagaaacccagtctcttttcccccatgttgtagagaattcttacaatgcttggtagaaagagaattgaacaggtagatgggtggatggatacaagctggacagatggatggaggaagatcctccatccaatatagagctgttacctaaaaccctccatcccacctttaaaatcctagctcagccaggcgcggtggctcacacctgtaatcccagcactttgggaggccaaggcgggtggatcacttgaggtcgggggttcgagaccagtctgaccaacatggtgaaacccccttctccactaaaaatacaaaaaaaaaaaaaagttagccaggcagggtggcgcatgcctgtaatcccgctactcgggaggctgaggcaggagaatggcttgcacccaggaggtggaggttgtggtgagccaagatcacgccattacactccagcctgggcaaagagagtgaaactgtctcaaaaaacaaaacaaatgacccccctgccaaaaaaaaaaaaaaaaaaaaagaaaagaaaaaaagaaaagcctagctcagctcacactgtcaggaataagtaagctagctggaatcatctctttcttaaaaccctgccttgatagtggatttttacatactttttttttaattctagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcggtgagaagggggtggtatgtccactctgttgccatgcagaaactgacttatgcatactgggtagccacagggtgactttttataacaatccacaaagacaggttcttattcccatttaatacacaagcacagagaggttcagtagctgacccaaggtcacacagctaagtcataccctagaagagcatgtcctttgatatacatacctgggcaagtggttgtcatgacaagaagcaaaatagacggagaagtgtgctcagtggctgaaaattctctgatgctactggggccaggattctgacctaagaaacatcgccctgtctttcagctcaaccaactcttccgaaacagcagcatcaagagttatttttctgactgtcaagtttcaacattcaggtaagttctaactcaggacctaatgactctaggaacttctgctgtcctttaaatagaagtgtccccaagccatagctttgatggaagagagccctagaaatagagagctgttaactaaaaactagctttttcctaaagctggagcccaactggcttcaacactcaagagagctggtgtaaatctcagcagacataaaggtacctggtgctgaggccatggagtctagagtgtagaatctactacattaagacatcagctactgaaatcaggacccatggaagacgggggaaggaggggactaaaaccagattacttagaatctagcagcctaactgtgcttttcaatgagaggtatcatttccaatggtggggggtaccaatgattttttttttttgacaactgccttgagaacaggctttcctcactaaacaaattctgaatcagaacaaataaagataagccctgagaatagggctttttcaaggagctgccaaacagatcaaatagtgactatgttctgcagattgatgtctggagaactctacagctattttgactgctaggcagctggttttcacagatatcatgattctgaggctgccagttttcaaagttaccgaggatcttgctggatgcagtggcttgcgactgtaatcccagccctttgggaggccaaggtgggtagatcgcttgagctcaggagtttgagaccagcctgggcaatatggtgaaaacccatctctacaaaaaatacaaaaatcagctgagcatagtggcatgtgctgtagtcccagttacttaggaggctgaggtgggaggatggcttgagcccaggaggcagaggttgcagtgagctgacattgtgccatgcactctagcctgggcaacagagccaaagcctgtctcaaaaaaaaaaaaacaaataataataataataaaatactgaggatcttgaaagagcactgtggaaataatgcaagttaaaatgccacaaagcttgctctttttactgagatttaacactttccttaactaaacacccctcgaatttttgcaagcctttggttcacttctagacttctggaaaaattgatttggactattttggccaatgttctcattgattttatgggtattcagaagttgttaccccaacattccagaaatgttctccctgtggctattactttatttatttatttatttatttatttatttatttatttgagacggagtctccctctgttgcccaggctggagtgcagtggcgcaatctcagctcactgcaacctccgcttcccaggttcaagcgattctcctgcctcagcctcccaagtagctgggattatggatgtgcaccaccacaccggctaatttttgtgtttttagtagagatggggtttcactgtgttggccaggctggtctcgaactcctgatctcaagtgatccacccgccttggcctcccaaagtgctgggataacaggcatgagccactgtgcctgacctccctgtggctatttttaaatgaattaagtggaataaaattagaaattcagttcttctcccacgctagctgcattttaagcatttaataacaacatgaagctactaatggctgcattgtgtagtgcagatgtagaattttttttttgttttttgttttgtttttgagatggagtctcgctctgtcaccaggctagagtgcagtggcgtgatctcgtctcactgcaatctctactccccgattcaagtgattctcctgcctcagcctcccaagtagctgggattacaggcacgtgccaccacacccagctaatatttgtatggatggtctcaatctcctgacctcgtgatttgtatggatggtctcgatctgacctcatgatccgcctgcctgggcctcccaaagtgctgggattacaggcgtgagccactgtgcccggccgacatagaatgtttacatcattgcagaaagtttctgcaggaagagcctagaaggagaaagcctagaatcatgataaaattgcagatatctttgcttatccctgtccccttccaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatggtaaagctccctgggtcattgggactgaggtggaagctcccacttcctcacctgggtccttccctgggaatctgaaggcttggggttgattcgtcatcgagctttctcagactgggagaaagtggcttagttctcctaagctttacccatcattgaaggaaagaaaaggacgcccgagggatatgggaggcatttgccctcttctggccagctctgtgacctcaggctagtcacatctcctttctggacttcttatctctctgtacttagcaagccacttggtttttggttcccatcttgcctgccctagatggtattgctcctccacccccaggcagctgcagtgttaaacaattaccctgattagttattgttgttgtgttgtttgtttgtttttgagacagggtctcactctgtcacctaggctggagtgcagtgacatgatctcagctcactgcaacctcaacccctggactcaagcaatccacccacttcagcctcccaagtaactgggactacagccatgcgccaccacacccggataatttttgtattttttctagagatggggttttgcaacattgcccaggctggtcttgaactcctgagctcaagcatgccacctgcttcagcctcccaaagtgctgggattacaggcaggcaggcaccactgcagctggttctggttttttgtgtttgtttttttcttttagaggcagggtctcgctctgttaaccagaatggagtacagtggtgcaatcatagctcactgcagtcttgaactcctgggctcaagcgatcctcccacctcagcctcctgagtacctggaactacaggcacgtgtcaccacgccttgctaatttctaaattttttgtagagacagggtctcactatgttgcccagactggtctctaattcctggccacaagtgatcctcctgcctcagcaggtcaatgagggcttccagtttcaagttgtatgtgattcatcctcaacaaatgtggtaggatggacctattttccaactccagagatggcttcaaggtggctcaactttgcatatccaattttacccattcaaagaatagttatatacattgtaccatgtatcaggaatataacagagagtaactgtttgctctttcaccactatattccaagaaccccatattctgcctggcacataataaacactcaagtcatatttgcagaaggaataactagatttcatacaaggttcttttcaagtcaaatgcgaataacgttttagacgggaccttccaatgcctgtgtgcactgtccttgattccgaattattgttgtgcaagagagcactgttgatccttcagaatcaacaagcctttcacatgcctgtcacaggtttttctttttcttgttttaccaattttgtttgttgtttgtttgttgttattgttttgttttgtttttgttttttatttgtttttattttttctttttttttgagacagagtctcgctctgtcacccaggctggagtgcagtggcacgatctccgcccactgcaagctccgcctcctgggttcatgccattttcctgcctcagcctcctgagtagctgggactacaggcgcctgccaccatgtctggctaattttttttgtatttttagtagaaacagggtttcaccatgttgaccaggatggtctcgatctcctgacctcgtgatctgcccacctgggcctcccaaagtgctgggattacaggcgtgagccaccacacccagccccaattttttttttaattaaaattgttgtcagctcacaagctttctaaaaacaggccatggacccagcatcgctgtagtttgccaaacccttgccttgaatcagtaccatccaatagaactttctgcagtgatagaaaatgtttctatctgtgctattcagcacaaagccatgtgtgattactaagcttgaagtgtggttaatgtaactgagataccgaagttttaattttatttaattttaatttaaaaagccacttgtggctgctccatattgcacactactttttaaaattattatttgtatatatttaaggggcacaagtacaattttgttgcatggatttatagcccagtggggaagtctgggcttttagggtatctattacctgaataatgtacattgtacccattgagtaatttctcatcatccactctcctccactccccaacccttccaagtttccactgtctattattccactctctatgtccatgcctatgcattatttagcattgacatgtctatgcattatttagtcaaatacatgtgctatttgacttcctgtatctgagttgtttgacttaagataatgaccttcacttgcatccatgttgctgcaaaagacatgatttcattcttttttatgcctgggtggtattgcattgtgtgtgtgtgtgtgtgtgtgtgtgtagagagagagagagatcacattttctttatacagtcctccattgatgggcacttaggttgattccatatctttgctattgtgaatagttttgtgataaacacacaggttcaggtgtctttttgacaaaattatttattttcctttgtgtagatacccagtcgtgggattcctggatcaaatggtagtttcatttttagttatttgagaaatctccacgtttttcatagagattatactaaattacattcccaccaacagtgtgtaacggttcacttttcttgcatcctttttaacatctgttatttttgtctttttagtaacagccattctgactggcgtaaggtggtatctcatcatggttttaatctgtatttctctgattattagtaatgtcgagcattttttcatatgcttgttagccattggtatgtcttctacatctttaagaagctggctatgggctgggcgcagtggctcacacctgtaatcccagcactttgggaggccgaggcaggcggatcacgaggtcaggagttaaaaaccagcctggccaacatggtaaaaccctgcctctactaaaaatacaaaaaattacccaggcatggtggtgcgcctgtaatcccagctactcaggaagctgaggcaggagaatcacttgaacccaggaggcggaggttgcagtgagacgagatcacatcattgcactccagcctgggtgacagagtgagactctatcttgagaaaaaaaaaaagttggctataacagggttgtagaagtagaggaaccagtaacccttctcgccatgcctgatgatggctttacatccctgtcttcatggagtttatgctgtcgtgaggaataacaagaacaggcagttgtcaattataaattatttgatgtgaacctattcatacatgggtgtggtcatcagggaaggcttcctggaggaaatgacattgaaggtgaattctaaaagatgacgataaaccaccaagtgaaggagagcttaaatgtgtttttaggcagaagaaaaaccttttgggtgaaaattttaaaacttagagaggtcccatcagtttccaactgcgatgatccattctctccaccactgcccttgggcccagcccaatttaggtccaccatgcccagaggcatgaatttaacttatgacactcttgtggtggaataatggctttgggcttatgtagccatgtgtcatttttttagagatacaaattgaaatatttggggtgagatgtcatggtgtctactggcctctaaaacttcagtgaaaacatttactttcactgaaatgtcaataaatcataaattggatgtatatgttttagttggaggaaatataaaccactaaatctaggtgatgcatatttattatactcttctctctgcttttttgtacgcttgtaaaattgtatttaaaagaataagacacacttggccgggcgcggtggctcacgcctgtaatcccagcactttgggagaccgaggtgggtggatcatgaggtcaggagttcaagaccagcctggccaacatggtaaaactccatcactacatacaaaaattagccaggcattttggcgggcacctgtaatctcagctacttgggaggctgaagcaggagaattgcttgaacccgggaagcagaggttgcagtgagccaagatcacgccactgcactctagcctgggcaacagagcaagactccatctccagaaaaaaaaaaaaaaaaagacacactcacatgcaccctccatttctttcatttctagggtattctcccaacagaaatgagcccttaactgggaattctggtaagtctcaaagaagccccagcccagggtagggagggggtagcctgatggtgctttgccttgtccaagagcaccaggcacacagagtcttggatgaggatcaaaattgccaacccatggcaaagactattgaggcatagtaaagggatagcagggatcctggctttctgggggcccagtttttgggggcatcagaggcatgaggtgttgagccactaagctctcttccccaggggctgtgcccatcctcaggccacatagggtccaagaaggagccctgggacgtggcaggaggtggctcaccccagcccttgtctccccagaccttcccttctgggctgtcatcctcatcggcttggcaggactcctgggagtcatcacatgcctgatctgcggtgtcctggtgagcaaggaagggttgcttgtcttcttaacaattgggttgtaagagttcttaatatattataaaaccatactatactatacacaagtcctttgctggatatatgttttgcaaatattttctcccagttcacggagtggctttcctattttctttttataattttatttttaattaattgacaaataatgaatgcatatatttaggggatacaatgtgatgctttggtatatgtacaattatggaatgactcaatcaagctaattaatatgtccctcacctctcatacttattatttctttgtggtgtgaacattggcaacctatactcttagcaattttgaaatctacattattattaactatagttactatgttatgcagatctcaaaaacttcacaacctatatgctgattacaagatattgagagaaaaagtgattgcaaagagtgtaaataaaataatgtaagagggaaaaatgtaacaaaattagtcgttagggaaatgtacacggaagtcacaatgagaggccacttttcacaagaatggataaaattgaaaagattgactataacaagtgttggtgaaaatgtgacagaactggaactctcataaagtgaaagtggaaaatagcttggccatttctttgaaaattacacacacctaccgtaagacctaccatcccactactagtaatttatctaagagaaataaaaacatatgtctatatgaagacttgtacacaagtaaatgttcataacagctttgtttgtaatagccaaactctgaaaacaagcccctaatgtccattaacaaatatatcctgacaatggaatattattcagcaacaaaaaggaattattaatacattaataaattatacagcaacatgtataaattgcaaaatagttatgcctagtgaaagaatccagatgaagaaaagagtacatgccatatgattcccttaatagacaaattctagaaaatacaaactaatctgtaaggacaggaatcagatcagcggttgcctgggaatgaaaatgtgtttgcagtggcagggaaaaaggaattgtaaaagagcaggaagaaagtttttttgttgttttttttttgttttttcttgagacagagtcttagtctatcgcccaagctggagtgcaatggcacgatctcagctcattgcaacctctgcctctcgggttcaagcgtttttcctgccccagcctcccaagtagctgggattacacatgcgcaccaccacactcagctaatttttgtatttttagtagagacggggttttaccatgttggccaggctggtctcgaactcctgacctcaggtgatccacccgccttggcctcccaaagtgctgggattacaggagtgagccaccatgcctggccaggacgaaagttttggggatgatggatggatgttccttatgttgattgtggtgacgattcaataagttatgatcagaacttatcaaaacattcactttaaatgtgtgcagtttattttatgtcagttatgcctcagttaagctggacagatgtagaggaggaagggagggagagagggggctgagatcaggaccaaaagccagagagaaagagactgagaatgagatgagagagaaatggtatttagacagaagacaggcgatagatgattgatagttgacagatgattggtggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaggtttaaacaaaacgcaattatgttgaaatgacaatgattgtggatataaaggtagatagaaatagatatttgtgaagataatggttagataaaaatgataggtaacagatattgatagatcttgataagtagatgataaatacatgattgatggatgacaggtgattgatagatgatttgatggattataaataggagatgattgagaggtgagagataattgatggttatttgattggtagataattgattgacaggttgataaatattgatagctagatgatagataaatagatcattggtagatatgtgatatattgataaagaaattcagaggcaaaaggagagagaaatgaaggggatatcggagggggaaaaatttttttaaaccgagagtgaaacaaggagacagaagaaaagaaagtggtgaaaagaggaaaagaactgagggagaaattaaatgaaacaatgaagggagacagaggaagcataaggcctctggctttggccatattctcacccctgtggtctcctctccctggacggctgaccagtccattctcacgcctcctcctcaccctcataggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcgg

SEQ ID NO: 314 - DNA, 66765 bp, Homo sapiens
  misc_feature (38757)..(38757): n is a, c, g, or t
  misc_feature (38775)..(38775): n is a, c, g, or t
  misc_feature (38778)..(38778): n is a, c, g, or t
  misc_feature (38835)..(38835): n is a, c, g, or t
  misc_feature (38838)..(38838): n is a, c, g, or t
  misc_feature (38859)..(38859): n is a, c, g, or t
  misc_feature (38868)..(38868): n is a, c, g, or t
  misc_feature (38883)..(38883): n is a, c, g, or t
  misc_feature (38892)..(38892): n is a, c, g, or t
  misc_feature (41833)..(41833): n is a, c, g, or t
  misc_feature (41838)..(41838): n is a, c, g, or t
  misc_feature (41843)..(41843): n is a, c, g, or t
  misc_feature (41847)..(41847): n is a, c, g, or t
  misc_feature (41859)..(41859): n is a, c, g, or t
  misc_feature (41865)..(41865): n is a, c, g, or t
  misc_feature (41874)..(41876): n is a, c, g, or t
  misc_feature (41881)..(41883): n is a, c, g, or t
  misc_feature (41892)..(41892): n is a, c, g, or t
  misc_feature (41911)..(41911): n is a, c, g, or t
  misc_feature (41942)..(41942): n is a, c, g, or t
  misc_feature (41945)..(41945): n is a, c, g, or t
  misc_feature (41951)..(41951): n is a, c, g, or t
  misc_feature (41986)..(41986): n is a, c, g, or t
  misc_feature (41989)..(41989): n is a, c, g, or t
  misc_feature (41991)..(41991): n is a, c, g, or t
  misc_feature (41994)..(41994): n is a, c, g, or t
  misc_feature (42000)..(42000): n is a, c, g, or t
  misc_feature (42016)..(42016): n is a, c, g, or t
  misc_feature (42022)..(42022): n is a, c, g, or t
  misc_feature (42026)..(42026): n is a, c, g, or t
  misc_feature (43909)..(43909): n is a, c, g, or t
  misc_feature (43911)..(43912): n is a, c, g, or t
  misc_feature (43916)..(43916): n is a, c, g, or t
  misc_feature (43927)..(43927): n is a, c, g, or t
  misc_feature (43929)..(43929): n is a, c, g, or t
  misc_feature (43932)..(43932): n is a, c, g, or t
  misc_feature (43939)..(43939): n is a, c, g, or t
  misc_feature (43947)..(43947): n is a, c, g, or t
  misc_feature (43965)..(43965): n is a, c, g, or t
  misc_feature (43968)..(43968): n is a, c, g, or t
  misc_feature (43970)..(43970): n is a, c, g, or t
  misc_feature (43974)..(43975): n is a, c, g, or t
  misc_feature (43982)..(43983): n is a, c, g, or t
  misc_feature (43985)..(43985): n is a, c, g, or t
  misc_feature (43989)..(43989): n is a, c, g, or t
  misc_feature (43992)..(43992): n is a, c, g, or t
  misc_feature (44013)..(44013): n is a, c, g, or t
  misc_feature (44377)..(44377): n is a, c, g, or t
  misc_feature (44379)..(44380): n is a, c, g, or t
  misc_feature (44384)..(44384): n is a, c, g, or t
  misc_feature (44395)..(44395): n is a, c, g, or t
  misc_feature (44397)..(44397): n is a, c, g, or t
  misc_feature (44400)..(44400): n is a, c, g, or t
  misc_feature (44407)..(44407): n is a, c, g, or t
  misc_feature (44415)..(44415): n is a, c, g, or t
  misc_feature (44433)..(44433): n is a, c, g, or t
  misc_feature (44436)..(44436): n is a, c, g, or t
  misc_feature (44438)..(44438): n is a, c, g, or t
  misc_feature (44442)..(44443): n is a, c, g, or t
  misc_feature (44450)..(44451): n is a, c, g, or t
  misc_feature (44453)..(44453): n is a, c, g, or t
  misc_feature (44457)..(44457): n is a, c, g, or t
  misc_feature (44460)..(44460): n is a, c, g, or t
  misc_feature (44481)..(44481): n is a, c, g, or t
  misc_feature (47185)..(47185): n is a, c, g, or t
  misc_feature (47187)..(47188): n is a, c, g, or t
  misc_feature (47192)..(47192): n is a, c, g, or t
  misc_feature (47203)..(47203): n is a, c, g, or t
  misc_feature (47205)..(47205): n is a, c, g, or t
  misc_feature (47208)..(47208): n is a, c, g, or t
  misc_feature (47215)..(47215): n is a, c, g, or t
  misc_feature (47223)..(47223): n is a, c, g, or t
  misc_feature (47241)..(47241): n is a, c, g, or t
  misc_feature (47244)..(47244): n is a, c, g, or t
  misc_feature (47246)..(47246): n is a, c, g, or t
  misc_feature (47250)..(47251): n is a, c, g, or t
  misc_feature (47258)..(47259): n is a, c, g, or t
  misc_feature (47261)..(47261): n is a, c, g, or t
  misc_feature (47265)..(47265): n is a, c, g, or t
  misc_feature (47268)..(47268): n is a, c, g, or t
  misc_feature (47289)..(47289): n is a, c, g, or t
  misc_feature (48118)..(48118): n is a, c, g, or t
  misc_feature (48120)..(48121): n is a, c, g, or t
  misc_feature (48125)..(48125): n is a, c, g, or t
  misc_feature (48136)..(48136): n is a, c, g, or t
  misc_feature (48138)..(48138): n is a, c, g, or t
  misc_feature (48141)..(48141): n is a, c, g, or t
  misc_feature (48148)..(48148): n is a, c, g, or t
  misc_feature (48156)..(48156): n is a, c, g, or t
  misc_feature (48174)..(48174): n is a, c, g, or t
  misc_feature (48177)..(48177): n is a, c, g, or t
  misc_feature (48179)..(48179): n is a, c, g, or t
  misc_feature (48183)..(48184): n is a, c, g, or t
  misc_feature (48191)..(48192): n is a, c, g, or t
  misc_feature (48194)..(48194): n is a, c, g, or t
  misc_feature (48198)..(48198): n is a, c, g, or t
  misc_feature (48201)..(48201): n is a, c, g, or t
  misc_feature (48222)..(48222): n is a, c, g, or t
  misc_feature (48226)..(48226): n is a, c, g, or t
  misc_feature (48228)..(48228): n is a, c, g, or t
  misc_feature (48231)..(48231): n is a, c, g, or t
  misc_feature (48246)..(48249): n is a, c, g, or t
  misc_feature (48253)..(48253): n is a, c, g, or t
  misc_feature (48255)..(48255): n is a, c, g, or t
  misc_feature (48265)..(48265): n is a, c, g, or t
  misc_feature (48273)..(48273): n is a, c, g, or t
  misc_feature (48278)..(48278): n is a, c, g, or t
  misc_feature (48305)..(48306): n is a, c, g, or t
  misc_feature (48313)..(48313): n is a, c, g, or t
  misc_feature (48315)..(48315): n is a, c, g, or t
  misc_feature (48322)..(48322): n is a, c, g, or t
  misc_feature (48327)..(48327): n is a, c, g, or t
  misc_feature (48340)..(48340): n is a, c, g, or t
  misc_feature (48356)..(48356): n is a, c, g, or t
  misc_feature (48362)..(48363): n is a, c, g, or t
  misc_feature (48365)..(48365): n is a, c, g, or t
  misc_feature (48367)..(48367): n is a, c, g, or t
  misc_feature (48369)..(48369): n is a, c, g, or t
  misc_feature (48378)..(48378): n is a, c, g, or t
  misc_feature (48388)..(48388): n is a, c, g, or t
  misc_feature (48393)..(48393): n is a, c, g, or t
  misc_feature (48398)..(48398): n is a, c, g, or t
  misc_feature (48402)..(48402): n is a, c, g, or t
  misc_feature (48414)..(48414): n is a, c, g, or t
  misc_feature (48420)..(48420): n is a, c, g, or t
  misc_feature (48429)..(48431): n is a, c, g, or t
  misc_feature (48436)..(48438): n is a, c, g, or t
  misc_feature (48447)..(48447): n is a, c, g, or t
  misc_feature (48466)..(48466): n is a, c, g, or t
  misc_feature (49006)..(49006): n is a, c, g, or t
  misc_feature (49009)..(49009): n is a, c, g, or t
  misc_feature (49011)..(49011): n is a, c, g, or t
  misc_feature (49014)..(49014): n is a, c, g, or t
  misc_feature (49020)..(49020): n is a, c, g, or t
  misc_feature (49036)..(49036): n is a, c, g, or t
  misc_feature (49042)..(49042): n is a, c, g, or t
  misc_feature (49046)..(49046): n is a, c, g, or t
  misc_feature (49321)..(49321): n is a, c, g, or t
  misc_feature (49326)..(49326): n is a, c, g, or t
  misc_feature (49331)..(49331): n is a, c, g, or t
  misc_feature (49335)..(49335): n is a, c, g, or t
  misc_feature (49347)..(49347): n is a, c, g, or t
  misc_feature (49353)..(49353): n is a, c, g, or t
  misc_feature (49362)..(49364): n is a, c, g, or t
  misc_feature (49369)..(49371): n is a, c, g, or t
  misc_feature (49380)..(49380): n is a, c, g, or t
  misc_feature (49399)..(49399): n is a, c, g, or t
  misc_feature (49430)..(49430): n is a, c, g, or t
  misc_feature (49433)..(49433): n is a, c, g, or t
  misc_feature (49439)..(49439): n is a, c, g, or t
  misc_feature (49474)..(49474): n is a, c, g, or t
  misc_feature (49477)..(49477): n is a, c, g, or t
  misc_feature (49479)..(49479): n is a, c, g, or t
  misc_feature (49482)..(49482): n is a, c, g, or t
  misc_feature (49488)..(49488): n is a, c, g, or t
  misc_feature (49504)..(49504): n is a, c, g, or t
  misc_feature (49510)..(49510): n is a, c, g, or t
  misc_feature (49514)..(49514): n is a, c, g, or t
  misc_feature (49519)..(49519): n is a, c, g, or t
  misc_feature (49521)..(49522): n is a, c, g, or t
  misc_feature (49526)..(49526): n is a, c, g, or t
  misc_feature (49537)..(49537): n is a, c, g, or t
  misc_feature (49539)..(49539): n is a, c, g, or t
  misc_feature (49542)..(49542): n is a, c, g, or t
  misc_feature (49549)..(49549): n is a, c, g, or t
  misc_feature (49557)..(49557): n is a, c, g, or t
  misc_feature (49575)..(49575): n is a, c, g, or t
  misc_feature (49578)..(49578): n is a, c, g, or t
  misc_feature (49580)..(49580): n is a, c, g, or t
  misc_feature (49584)..(49585): n is a, c, g, or t
  misc_feature (49592)..(49593): n is a, c, g, or t
  misc_feature (49595)..(49595): n is a, c, g, or t
  misc_feature (49599)..(49599): n is a, c, g, or t
  misc_feature (49602)..(49602): n is a, c, g, or t
  misc_feature (49623)..(49623): n is a, c, g, or t
  misc_feature (50725)..(50725): n is a, c, g, or t
  misc_feature (50730)..(50730): n is a, c, g, or t
  misc_feature (50735)..(50735): n is a, c, g, or t
  misc_feature (50739)..(50739): n is a, c, g, or t
  misc_feature (50751)..(50751): n is a, c, g, or t
  misc_feature (50757)..(50757): n is a, c, g, or t
  misc_feature (50766)..(50768): n is a, c, g, or t
  misc_feature (50773)..(50775): n is a, c, g, or t
  misc_feature (50784)..(50784): n is a, c, g, or t
  misc_feature (50803)..(50803): n is a, c, g, or t
  misc_feature (50834)..(50834): n is a, c, g, or t
  misc_feature (50837)..(50837): n is a, c, g, or t
  misc_feature (50843)..(50843): n is a, c, g, or t
  misc_feature (50878)..(50878): n is a, c, g, or t
  misc_feature (50881)..(50881): n is a, c, g, or t
  misc_feature (50883)..(50883): n is a, c, g, or t
  misc_feature (50886)..(50886): n is a, c, g, or t
  misc_feature (50892)..(50892): n is a, c, g, or t
  misc_feature (50908)..(50908): n is a, c, g, or t
  misc_feature (50914)..(50914): n is a, c, g, or t
  misc_feature (50918)..(50918): n is a, c, g, or t
  misc_feature (50923)..(50923): n is a, c, g, or t
  misc_feature (50925)..(50926): n is a, c, g, or t
  misc_feature (50930)..(50930): n is a, c, g, or t
  misc_feature (50941)..(50941): n is a, c, g, or t
  misc_feature (50943)..(50943): n is a, c, g, or t
  misc_feature (50946)..(50946): n is a, c, g, or t
  misc_feature (50953)..(50953): n is a, c, g, or t
  misc_feature (50961)..(50961): n is a, c, g, or t
  misc_feature (50979)..(50979): n is a, c, g, or t
  misc_feature (50982)..(50982): n is a, c, g, or t
  misc_feature (50984)..(50984): n is a, c, g, or t
  misc_feature (50988)..(50989): n is a, c, g, or t
  misc_feature (50996)..(50997): n is a, c, g, or t
  misc_feature (50999)..(50999): n is a, c, g, or t
  misc_feature (51003)..(51003): n is a, c, g, or t
  misc_feature (51006)..(51006): n is a, c, g, or t
  misc_feature (51027)..(51027): n is a, c, g, or t
  misc_feature (52597)..(52597): n is a, c, g, or t
  misc_feature (52602)..(52602): n is a, c, g, or t
  misc_feature (52607)..(52607): n is a, c, g, or t
  misc_feature (52611)..(52611): n is a, c, g, or t
  misc_feature (52623)..(52623): n is a, c, g, or t
  misc_feature (52629)..(52629): n is a, c, g, or t
  misc_feature (52638)..(52640): n is a, c, g, or t
  misc_feature (52645)..(52647): n is a, c, g, or t
  misc_feature (52656)..(52656): n is a, c, g, or t
  misc_feature (52675)..(52675): n is a, c, g, or t
  misc_feature (52706)..(52706): n is a, c, g, or t
  misc_feature (52709)..(52709): n is a, c, g, or t
  misc_feature (52715)..(52715): n is a, c, g, or t
  misc_feature (52750)..(52750): n is a, c, g, or t
  misc_feature (52753)..(52753): n is a, c, g, or t
  misc_feature (52755)..(52755): n is a, c, g, or t
  misc_feature (52758)..(52758): n is a, c, g, or t
  misc_feature (52764)..(52764): n is a, c, g, or t
  misc_feature (52780)..(52780): n is a, c, g, or t
  misc_feature (52786)..(52786): n is a, c, g, or t
  misc_feature (52790)..(52790): n is a, c, g, or t
  misc_feature (52795)..(52795): n is a, c, g, or t
  misc_feature (52797)..(52798): n is a, c, g, or t
  misc_feature (52802)..(52802): n is a, c, g, or t
  misc_feature (52813)..(52813): n is a, c, g, or t
  misc_feature (52815)..(52815): n is a, c, g, or t
  misc_feature (52818)..(52818): n is a, c, g, or t
  misc_feature (52825)..(52825): n is a, c, g, or t
  misc_feature (52833)..(52833): n is a, c, g, or t
  misc_feature (52851)..(52851): n is a, c, g, or t
  misc_feature (52854)..(52854): n is a, c, g, or t
  misc_feature (52856)..(52856): n is a, c, g, or t
  misc_feature (52860)..(52861): n is a, c, g, or t
  misc_feature (52868)..(52869): n is a, c, g, or t
  misc_feature (52871)..(52871): n is a, c, g, or t
  misc_feature (52875)..(52875): n is a, c, g, or t
  misc_feature (52878)..(52878): n is a, c, g, or t
  misc_feature (52899)..(52899): n is a, c, g, or t
  misc_feature (52903)..(52903): n is a, c, g, or t
  misc_feature (52905)..(52905): n is a, c, g, or t
  misc_feature (52908)..(52908): n is a, c, g, or t
  misc_feature (52923)..(52926): n is a, c, g, or t
  misc_feature (52930)..(52930): n is a, c, g, or t
  misc_feature (52932)..(52932): n is a, c, g, or t
  misc_feature (52942)..(52942): n is a, c, g, or t
  misc_feature (52950)..(52950): n is a, c, g, or t
  misc_feature (52955)..(52955): n is a, c, g, or t
  misc_feature (52982)..(52983): n is a, c, g, or t
  misc_feature (52990)..(52990): n is a, c, g, or t
  misc_feature (52992)..(52992): n is a, c, g, or t
  misc_feature (52999)..(52999): n is a, c, g, or t
  misc_feature (53004)..(53004): n is a, c, g, or t
  misc_feature (53017)..(53017): n is a, c, g, or t
  misc_feature (53033)..(53033): n is a, c, g, or t
  misc_feature (53039)..(53040): n is a, c, g, or t
  misc_feature (53042)..(53042): n is a, c, g, or t
  misc_feature (53044)..(53044): n is a, c, g, or t
  misc_feature (53046)..(53046): n is a, c, g, or t
  misc_feature (53055)..(53055): n is a, c, g, or t
  misc_feature (53065)..(53065): n is a, c, g, or t
  misc_feature (53070)..(53070): n is a, c, g, or t
  misc_feature (53075)..(53075): n is a, c, g, or t
  misc_feature (53079)..(53079): n is a, c, g, or t
  misc_feature (53091)..(53091): n is a, c, g, or t
  misc_feature (53097)..(53097): n is a, c, g, or t
  misc_feature (53533)..(53533): n is a, c, g, or t
  misc_feature (53538)..(53538): n is a, c, g, or t
  misc_feature (53543)..(53543): n is a, c, g, or t
  misc_feature (53547)..(53547): n is a, c, g, or t
  misc_feature (53559)..(53559): n is a, c, g, or t
  misc_feature (53565)..(53565): n is a, c, g, or t
  misc_feature (53574)..(53576): n is a, c, g, or t
  misc_feature (53581)..(53583): n is a, c, g, or t
  misc_feature (53592)..(53592): n is a, c, g, or t
  misc_feature (53611)..(53611): n is a, c, g, or t
  misc_feature (53642)..(53642): n is a, c, g, or t
  misc_feature (53645)..(53645): n is a, c, g, or t
  misc_feature (53651)..(53651): n is a, c, g, or t
  misc_feature (53686)..(53686): n is a, c, g, or t
  misc_feature (53689)..(53689): n is a, c, g, or t
  misc_feature (53691)..(53691): n is a, c, g, or t
  misc_feature (53694)..(53694): n is a, c, g, or t
  misc_feature (53700)..(53700): n is a, c, g, or t
  misc_feature (53716)..(53716): n is a, c, g, or t
  misc_feature (53722)..(53722): n is a, c, g, or t
  misc_feature (53726)..(53726): n is a, c, g, or t
  misc_feature (53731)..(53731): n is a, c, g, or t
  misc_feature (53733)..(53734): n is a, c, g, or t
  misc_feature (53738)..(53738): n is a, c, g, or t
  misc_feature (53749)..(53749): n is a, c, g, or t
  misc_feature (53751)..(53751): n is a, c, g, or t
  misc_feature (53754)..(53754): n is a, c, g, or t
  misc_feature (53761)..(53761): n is a, c, g, or t
  misc_feature (53769)..(53769): n is a, c, g, or t
  misc_feature (53787)..(53787): n is a, c, g, or t
  misc_feature (53790)..(53790): n is a, c, g, or t
  misc_feature (53792)..(53792): n is a, c, g, or t
  misc_feature (53796)..(53797): n is a, c, g, or t
  misc_feature (53804)..(53805): n is a, c, g, or t
  misc_feature (53807)..(53807): n is a, c, g, or t
  misc_feature (53811)..(53811): n is a, c, g, or t
  misc_feature (53814)..(53814): n is a, c, g, or t
  misc_feature (53835)..(53835): n is a, c, g, or t
  misc_feature (53839)..(53839): n is a, c, g, or t
  misc_feature (53841)..(53841): n is a, c, g, or t
  misc_feature (53844)..(53844): n is a, c, g, or t
  misc_feature (53859)..(53862): n is a, c, g, or t
  misc_feature (53866)..(53866): n is a, c, g, or t
  misc_feature (53868)..(53868): n is a, c, g, or t
  misc_feature (53878)..(53878): n is a, c, g, or t
  misc_feature (53886)..(53886): n is a, c, g, or t
  misc_feature (53891)..(53891): n is a, c, g, or t
  misc_feature (53918)..(53919): n is a, c, g, or t
  misc_feature (53926)..(53926): n is a, c, g, or t
  misc_feature (53928)..(53928): n is a, c, g, or t
  misc_feature (53935)..(53935): n is a, c, g, or t
  misc_feature (53940)..(53940): n is a, c, g, or t
  misc_feature (53953)..(53953): n is a, c, g, or t
  misc_feature (53969)..(53969): n is a, c, g, or t
  misc_feature (53975)..(53976): n is a, c, g, or t
  misc_feature (53978)..(53978): n is a, c, g, or t
  misc_feature (53980)..(53980): n is a, c, g, or t
  misc_feature (53982)..(53982): n is a, c, g, or t
  misc_feature (53991)..(53991): n is a, c, g, or t
  misc_feature (54001)..(54001): n is a, c, g, or t
  misc_feature (54006)..(54006): n is a, c, g, or t
  misc_feature (54011)..(54011): n is a, c, g, or t
  misc_feature (54015)..(54015): n is a, c, g, or t
  misc_feature (54027)..(54027): n is a, c, g, or t
  misc_feature (54033)..(54033): n is a, c, g, or t
  misc_feature (54042)..(54044): n is a, c, g, or t
  misc_feature (54049)..(54051): n is a, c, g, or t
  misc_feature (54060)..(54060): n is a, c, g, or t
  misc_feature (54079)..(54079): n is a, c, g, or t
  misc_feature (54469)..(54469): n is a, c, g, or t
  misc_feature (54474)..(54474): n is a, c, g, or t
  misc_feature (54479)..(54479): n is a, c, g, or t
  misc_feature (54483)..(54483): n is a, c, g, or t
  misc_feature (54495)..(54495): n is a, c, g, or t
  misc_feature (54501)..(54501): n is a, c, g, or t
  misc_feature (54510)..(54512): n is a, c, g, or t
  misc_feature (54517)..(54519): n is a, c, g, or t
  misc_feature (54528)..(54528): n is a, c, g, or t
  misc_feature (54547)..(54547): n is a, c, g, or t
  misc_feature (54578)..(54578): n is a, c, g, or t
  misc_feature (54581)..(54581): n is a, c, g, or t
  misc_feature (54587)..(54587): n is a, c, g, or t
  misc_feature (54622)..(54622): n is a, c, g, or t
  misc_feature (54625)..(54625): n is a, c, g, or t
  misc_feature (54627)..(54627): n is a, c, g, or t
  misc_feature (54630)..(54630): n is a, c, g, or t
  misc_feature (54636)..(54636): n is a, c, g, or t
  misc_feature (54652)..(54652): n is a, c, g, or t
  misc_feature (54658)..(54658): n is a, c, g, or t
  misc_feature (54662)..(54662): n is a, c, g, or t
  misc_feature (54667)..(54667): n is a, c, g, or t
  misc_feature (54669)..(54670): n is a, c, g, or t
  misc_feature (54674)..(54674): n is a, c, g, or t
  misc_feature (54685)..(54685): n is a, c, g, or t
  misc_feature (54687)..(54687): n is a, c, g, or t
  misc_feature (54690)..(54690): n is a, c, g, or t
  misc_feature (54697)..(54697): n is a, c, g, or t
  misc_feature (54705)..(54705): n is a, c, g, or t
  misc_feature (54723)..(54723): n is a, c, g, or t
  misc_feature (54726)..(54726): n is a, c, g, or t
  misc_feature (54728)..(54728): n is a, c, g, or t
  misc_feature (54732)..(54733): n is a, c, g, or t
  misc_feature (54740)..(54741): n is a, c, g, or t
  misc_feature (54743)..(54743): n is a, c, g, or t
  misc_feature (54747)..(54747): n is a, c, g, or t
  misc_feature (54750)..(54750): n is a, c, g, or t
  misc_feature (54771)..(54771): n is a, c, g, or t
  misc_feature (54775)..(54775): n is a, c, g, or t
  misc_feature (54777)..(54777): n is a, c, g, or t
  misc_feature (54780)..(54780): n is a, c, g, or t
  misc_feature (54795)..(54798): n is a, c, g, or t
  misc_feature (54802)..(54802): n is a, c, g, or t
  misc_feature (54804)..(54804): n is a, c, g, or t
  misc_feature (54814)..(54814): n is a, c, g, or t
  misc_feature (54822)..(54822): n is a, c, g, or t
  misc_feature (54827)..(54827): n is a, c, g, or t
  misc_feature (54854)..(54855): n is a, c, g, or t
  misc_feature (54862)..(54862): n is a, c, g, or t
  misc_feature (54864)..(54864): n is a, c, g, or t
  misc_feature (54871)..(54871): n is a, c, g, or t
  misc_feature (54876)..(54876): n is a, c, g, or t
  misc_feature (54889)..(54889): n is a, c, g, or t
  misc_feature (54905)..(54905): n is a, c, g, or t
  misc_feature (54911)..(54912): n is a, c, g, or t
  misc_feature (54914)..(54914): n is a, c, g, or t
  misc_feature (54916)..(54916): n is a, c, g, or t
  misc_feature (54918)..(54918): n is a, c, g, or t
  misc_feature (54927)..(54927): n is a, c, g, or t
  misc_feature (54937)..(54937): n is a, c, g, or t
  misc_feature (54942)..(54942): n is a, c, g, or t
  misc_feature (54947)..(54947): n is a, c, g, or t
  misc_feature (54951)..(54951): n is a, c, g, or t
  misc_feature (54963)..(54963): n is a, c, g, or t
  misc_feature (54969)..(54969): n is a, c, g, or t
  misc_feature (54978)..(54980): n is a, c, g, or t
  misc_feature (54985)..(54987): n is a, c, g, or t
  misc_feature (54996)..(54996): n is a, c, g, or t
  misc_feature (55015)..(55015): n is a, c, g, or t
  misc_feature (55405)..(55405): n is a, c, g, or t
  misc_feature (55410)..(55410): n is a, c, g, or t
  misc_feature (55415)..(55415): n is a, c, g, or t
  misc_feature (55419)..(55419): n is a, c, g, or t
  misc_feature (55431)..(55431): n is a, c, g, or t
  misc_feature (55437)..(55437): n is a, c, g, or t
  misc_feature (55446)..(55448): n is a, c, g, or t
  misc_feature (55453)..(55455): n is a, c, g, or t
  misc_feature (55464)..(55464): n is a, c, g, or t
  misc_feature (55483)..(55483): n is a, c, g, or t
  misc_feature (55514)..(55514): n is a, c, g, or t
  misc_feature (55517)..(55517): n is a, c, g, or t
  misc_feature (55523)..(55523): n is a, c, g, or t
  misc_feature (55558)..(55558): n is a, c, g, or t
  misc_feature (55561)..(55561): n is a, c, g, or t
  misc_feature (55563)..(55563): n is a, c, g, or t
  misc_feature (55566)..(55566): n is a, c, g, or t
  misc_feature (55572)..(55572): n is a, c, g, or t
  misc_feature (55588)..(55588): n is a, c, g, or t
  misc_feature (55594)..(55594): n is a, c, g, or t
  misc_feature (55598)..(55598): n is a, c, g, or t
  misc_feature (55603)..(55603): n is a, c, g, or t
  misc_feature (55605)..(55606): n is a, c, g, or t
  misc_feature (55610)..(55610): n is a, c, g, or t
  misc_feature (55621)..(55621): n is a, c, g, or t
  misc_feature (55623)..(55623): n is a, c, g, or t
  misc_feature (55626)..(55626): n is a, c, g, or t
  misc_feature (55633)..(55633): n is a, c, g, or t
  misc_feature (55641)..(55641): n is a, c, g, or t
  misc_feature (55659)..(55659): n is a, c, g, or t
  misc_feature (55662)..(55662): n is a, c, g, or t
  misc_feature (55664)..(55664): n is a, c, g, or t
  misc_feature (55668)..(55669): n is a, c, g, or t
  misc_feature (55676)..(55677): n is a, c, g, or t
  misc_feature (55679)..(55679): n is a, c, g, or t
  misc_feature (55683)..(55683): n is a, c, g, or t
  misc_feature (55686)..(55686): n is a, c, g, or t
  misc_feature (55707)..(55707): n is a, c, g, or t
  misc_feature (55711)..(55711): n is a, c, g, or t
  misc_feature (55713)..(55713): n is a, c, g, or t
  misc_feature (55716)..(55716): n is a, c, g, or t
  misc_feature (55731)..(55734): n is a, c, g, or t
  misc_feature (55738)..(55738): n is a, c, g, or t
  misc_feature (55740)..(55740): n is a, c, g, or t
  misc_feature (55750)..(55750): n is a, c, g, or t
  misc_feature (55758)..(55758): n is a, c, g, or t
  misc_feature (55763)..(55763): n is a, c, g, or t
  misc_feature (55790)..(55791): n is a, c, g, or t
  misc_feature (55798)..(55798): n is a, c, g, or t
  misc_feature (55800)..(55800): n is a, c, g, or t
  misc_feature (55807)..(55807): n is a, c, g, or t
  misc_feature (55812)..(55812): n is a, c, g, or t
  misc_feature (55825)..(55825): n is a, c, g, or t
  misc_feature (55841)..(55841): n is a, c, g, or t
  misc_feature (55847)..(55848): n is a, c, g, or t
  misc_feature (55850)..(55850): n is a, c, g, or t
  misc_feature (55852)..(55852): n is a, c, g, or t
  misc_feature (55854)..(55854): n is a, c, g, or t
  misc_feature (55863)..(55863): n is a, c, g, or t
  misc_feature (55873)..(55873): n is a, c, g, or t
  misc_feature (55878)..(55878): n is a, c, g, or t
  misc_feature (55883)..(55883): n is a, c, g, or t
  misc_feature (55887)..(55887): n is a, c, g, or t
  misc_feature (55899)..(55899): n is a, c, g, or t
  misc_feature (55905)..(55905): n is a, c, g, or t
  misc_feature (55914)..(55916): n is a, c, g, or t
  misc_feature (55921)..(55923): n is a, c, g, or t
  misc_feature (55932)..(55932): n is a, c, g, or t
  misc_feature (55951)..(55951): n is a, c, g, or t
  misc_feature (56341)..(56341): n is a, c, g, or t
  misc_feature (56346)..(56346): n is a, c, g, or t
  misc_feature (56351)..(56351): n is a, c, g, or t
  misc_feature (56355)..(56355): n is a, c, g, or t
  misc_feature (56367)..(56367): n is a, c, g, or t
  misc_feature (56373)..(56373): n is a, c, g, or t
  misc_feature (56382)..(56384): n is a, c, g, or t
  misc_feature (56389)..(56391): n is a, c, g, or t
  misc_feature (56400)..(56400): n is a, c, g, or t
  misc_feature (56419)..(56419): n is a, c, g, or t
  misc_feature (56450)..(56450): n is a, c, g, or t
  misc_feature (56453)..(56453): n is a, c, g, or t
  misc_feature (56459)..(56459): n is a, c, g, or t
  misc_feature (56494)..(56494): n is a, c, g, or t
  misc_feature (56497)..(56497): n is a, c, g, or t
  misc_feature (56499)..(56499): n is a, c, g, or t
  misc_feature (56502)..(56502): n is a, c, g, or t
  misc_feature (56508)..(56508): n is a, c, g, or t
  misc_feature (56524)..(56524): n is a, c, g, or t
  misc_feature (56530)..(56530): n is a, c, g, or t
  misc_feature (56534)..(56534): n is a, c, g, or t
  misc_feature (56539)..(56539): n is a, c, g, or t
  misc_feature (56541)..(56542): n is a, c, g, or t
  misc_feature (56546)..(56546): n is a, c, g, or t
  misc_feature (56557)..(56557): n is a, c, g, or t
  misc_feature (56559)..(56559): n is a, c, g, or t
  misc_feature (56562)..(56562): n is a, c, g, or t
  misc_feature (56569)..(56569): n is a, c, g, or t
  misc_feature (56577)..(56577): n is a, c, g, or t
  misc_feature (56595)..(56595): n is a, c, g, or t
  misc_feature (56598)..(56598): n is a, c, g, or t
  misc_feature (56600)..(56600): n is a, c, g, or t
  misc_feature (56604)..(56605): n is a, c, g, or t
  misc_feature (56612)..(56613): n is a, c, g, or t
  misc_feature (56615)..(56615): n is a, c, g, or t
  misc_feature (56619)..(56619): n is a, c, g, or t
  misc_feature (56622)..(56622): n is a, c, g, or t
  misc_feature (56643)..(56643): n is a, c, g, or t
  misc_feature (56647)..(56647): n is a, c, g, or t
  misc_feature (56649)..(56649): n is a, c, g, or t
  misc_feature (56652)..(56652): n is a, c, g, or t
  misc_feature (56667)..(56670): n is a, c, g, or t
  misc_feature (56674)..(56674): n is a, c, g, or t
  misc_feature (56676)..(56676): n is a, c, g, or t
  misc_feature (56686)..(56686): n is a, c, g, or t
  misc_feature (56694)..(56694): n is a, c, g, or t
  misc_feature (56699)..(56699): n is a, c, g, or t
  misc_feature (56726)..(56727): n is a, c, g, or t
  misc_feature (56734)..(56734): n is a, c, g, or t
  misc_feature (56736)..(56736): n is a, c, g, or t
  misc_feature (56743)..(56743): n is a, c, g, or t
  misc_feature (56748)..(56748): n is a, c, g, or t
  misc_feature (56761)..(56761): n is a, c, g, or t
  misc_feature (56777)..(56777): n is a, c, g, or t
  misc_feature (56783)..(56784): n is a, c, g, or t
  misc_feature (56786)..(56786): n is a, c, g, or t
  misc_feature (56788)..(56788): n is a, c, g, or t
  misc_feature (56790)..(56790): n is a, c, g, or t
  misc_feature (56799)..(56799): n is a, c, g, or t
  misc_feature (56809)..(56809): n is a, c, g, or t
  misc_feature (56814)..(56814): n is a, c, g, or t
  misc_feature (56819)..(56819): n is a, c, g, or t
  misc_feature (56823)..(56823): n is a, c, g, or t
  misc_feature (56835)..(56835): n is a, c, g, or t
  misc_feature (56841)..(56841): n is a, c, g, or t
  misc_feature (56850)..(56852): n is a, c, g, or t
  misc_feature (56857)..(56859): n is a, c, g, or t
  misc_feature (56868)..(56868): n is a, c, g, or t
  misc_feature (56887)..(56887): n is a, c, g, or t
  misc_feature (57475)..(57475): n is a, c, g, or t
  misc_feature (57477)..(57478): n is a, c, g, or t
  misc_feature (57482)..(57482): n is a, c, g, or t
  misc_feature (57493)..(57493): n is a, c, g, or t
  misc_feature (57495)..(57495): n is a, c, g, or t
  misc_feature (57498)..(57498): n is a, c, g, or t
  misc_feature (57505)..(57505): n is a, c, g, or t
  misc_feature (57513)..(57513): n is a, c, g, or t
  misc_feature (57531)..(57531): n is a, c, g, or t
  misc_feature (57534)..(57534): n is a, c, g, or t
  misc_feature (57536)..(57536): n is a, c, g, or t
  misc_feature (57540)..(57541): n is a, c, g, or t
  misc_feature (57548)..(57549): n is a, c, g, or t
  misc_feature (57551)..(57551): n is a, c, g, or t
  misc_feature (57555)..(57555): n is a, c, g, or t
  misc_feature (57558)..(57558): n is a, c, g, or t
  misc_feature (57579)..(57579): n is a, c, g, or t
  misc_feature (57583)..(57583): n is a, c, g, or t
  misc_feature (57585)..(57585): n is a, c, g, or t
  misc_feature (57588)..(57588): n is a, c, g, or t
  misc_feature (57603)..(57606): n is a, c, g, or t
  misc_feature (57610)..(57610): n is a, c, g, or t
  misc_feature (57612)..(57612): n is a, c, g, or t
  misc_feature (57622)..(57622): n is a, c, g, or t
  misc_feature (57630)..(57630): n is a, c, g, or t
  misc_feature (57635)..(57635): n is a, c, g, or t
  misc_feature (57662)..(57663): n is a, c, g, or t
  misc_feature (57670)..(57670): n is a, c, g, or t
  misc_feature (57672)..(57672): n is a, c, g, or t
  misc_feature (57679)..(57679): n is a, c, g, or t
  misc_feature (57684)..(57684): n is a, c, g, or t
  misc_feature (57697)..(57697): n is a, c, g, or t
  misc_feature (57713)..(57713): n is a, c, g, or t
  misc_feature (57719)..(57720): n is a, c, g, or t
  misc_feature (57722)..(57722): n is a, c, g, or t
  misc_feature (57724)..(57724): n is a, c, g, or t
  misc_feature (57726)..(57726): n is a, c, g, or t
  misc_feature (57735)..(57735): n is a, c, g, or t
  misc_feature (57745)..(57745): n is a, c, g, or t
  misc_feature (57750)..(57750): n is a, c, g, or t
  misc_feature (57755)..(57755): n is a, c, g, or t
  misc_feature (57759)..(57759): n is a, c, g, or t
  misc_feature (57771)..(57771): n is a, c, g, or t
  misc_feature (57777)..(57777): n is a, c, g, or t
  misc_feature (57786)..(57788): n is a, c, g, or t
  misc_feature (57793)..(57795): n is a, c, g, or t
  misc_feature (57804)..(57804): n is a, c, g, or t
  misc_feature (57823)..(57823): n is a, c, g, or t
  misc_feature (58213)..(58213): n is a, c, g, or t
  misc_feature (58218)..(58218): n is a, c, g, or t
  misc_feature (58223)..(58223): n is a, c, g, or t
  misc_feature (58227)..(58227): n is a, c, g, or t
  misc_feature (58239)..(58239): n is a, c, g, or t
  misc_feature (58245)..(58245): n is a, c, g, or t
  misc_feature (58254)..(58256): n is a, c, g, or t
  misc_feature (58261)..(58263): n is a, c, g, or t
  misc_feature (58272)..(58272): n is a, c, g, or t
  misc_feature (58291)..(58291): n is a, c, g, or t
  misc_feature (58322)..(58322): n is a, c, g, or t
  misc_feature (58325)..(58325): n is a, c, g, or t
  misc_feature (58331)..(58331): n is a, c, g, or t
  misc_feature (58366)..(58366): n is a, c, g, or t
  misc_feature (58369)..(58369): n is a, c, g, or t
  misc_feature (58371)..(58371): n is a, c, g, or t
  misc_feature (58374)..(58374): n is a, c, g, or t
  misc_feature (58380)..(58380): n is a, c, g, or t
  misc_feature (58396)..(58396): n is a, c, g, or t
  misc_feature (58402)..(58402): n is a, c, g, or t
  misc_feature (58406)..(58406): n is a, c, g, or t
  misc_feature (58411)..(58411): n is a, c, g, or t
  misc_feature (58413)..(58414): n is a, c, g, or t
  misc_feature (58418)..(58418): n is a, c, g, or t
  misc_feature (58429)..(58429): n is a, c, g, or t
  misc_feature (58431)..(58431): n is a, c, g, or t
  misc_feature (58434)..(58434): n is a, c, g, or t
  misc_feature (58441)..(58441): n is a, c, g, or t
  misc_feature (58449)..(58449): n is a, c, g, or t
  misc_feature (58467)..(58467): n is a, c, g, or t
  misc_feature (58470)..(58470): n is a, c, g, or t
  misc_feature (58472)..(58472): n is a, c, g, or t
  misc_feature (58476)..(58477): n is a, c, g, or t
  misc_feature (58484)..(58485): n is a, c, g, or t
  misc_feature (58487)..(58487): n is a, c, g, or t
  misc_feature (58491)..(58491): n is a, c, g, or t
  misc_feature (58494)..(58494): n is a, c, g, or t
  misc_feature (58515)..(58515): n is a, c, g, or t
  misc_feature (58519)..(58519): n is a, c, g, or t
  misc_feature (58521)..(58521): n is a, c, g, or t
  misc_feature (58524)..(58524): n is a, c, g, or t
  misc_feature (58539)..(58542): n is a, c, g, or t
  misc_feature (58546)..(58546): n is a, c, g, or t
  misc_feature (58548)..(58548): n is a, c, g, or t
  misc_feature (58558)..(58558): n is a, c, g, or t
  misc_feature (58566)..(58566): n is a, c, g, or t
  misc_feature (58571)..(58571): n is a, c, g, or t
  misc_feature (58598)..(58599): n is a, c, g, or t
  misc_feature (58606)..(58606): n is a, c, g, or t
  misc_feature (58608)..(58608): n is a, c, g, or t
  misc_feature (58615)..(58615): n is a, c, g, or t
  misc_feature (58620)..(58620): n is a, c, g, or t
  misc_feature (58633)..(58633): n is a, c, g, or t
  misc_feature (58649)..(58649): n is a, c, g, or t
  misc_feature (58655)..(58656): n is a, c, g, or t
  misc_feature (58658)..(58658): n is a, c, g, or t
  misc_feature (58660)..(58660): n is a, c, g, or t
  misc_feature (58662)..(58662): n is a, c, g, or t
  misc_feature (58671)..(58671): n is a, c, g, or t
  misc_feature (58681)..(58681): n is a, c, g, or t
  misc_feature (58686)..(58686): n is a, c, g, or t
  misc_feature (58691)..(58691): n is a, c, g, or t
  misc_feature (58695)..(58695): n is a, c, g, or t
  misc_feature (58707)..(58707): n is a, c, g, or t
  misc_feature (58713)..(58713): n is a, c, g, or t
  misc_feature (58722)..(58724): n is a, c, g, or t
  misc_feature (58729)..(58731): n is a, c, g, or t
  misc_feature (58740)..(58740): n is a, c, g, or t
  misc_feature (58759)..(58759): n is a, c, g, or t
  misc_feature (59149)..(59149): n is a, c, g, or t
  misc_feature (59154)..(59154): n is a, c, g, or t
  misc_feature (59159)..(59159): n is a, c, g, or t
  misc_feature (59163)..(59163): n is a, c, g, or t
  misc_feature (59175)..(59175): n is a, c, g, or t
  misc_feature (59181)..(59181): n is a, c, g, or t
  misc_feature (59190)..(59192): n is a, c, g, or t
  misc_feature (59197)..(59199): n is a, c, g, or t
  misc_feature (59208)..(59208): n is a, c, g, or t
  misc_feature (59227)..(59227): n is a, c, g, or t
  misc_feature (59258)..(59258): n is a, c, g, or t
  misc_feature (59261)..(59261): n is a, c, g, or t
  misc_feature (59267)..(59267): n is a, c, g, or t
  misc_feature (59302)..(59302): n is a, c, g, or t
  misc_feature (59305)..(59305): n is a, c, g, or t
  misc_feature (59307)..(59307): n is a, c, g, or t
  misc_feature (59310)..(59310): n is a, c, g, or t
  misc_feature (59316)..(59316): n is a, c, g, or t
  misc_feature (59332)..(59332): n is a, c, g, or t
  misc_feature (59338)..(59338): n is a, c, g, or t
  misc_feature (59342)..(59342): n is a, c, g, or t
  misc_feature (59347)..(59347): n is a, c, g, or t
  misc_feature (59349)..(59350): n is a, c, g, or t
  misc_feature (59354)..(59354): n is a, c, g, or t
  misc_feature (59365)..(59365): n is a, c, g, or t
  misc_feature (59367)..(59367): n is a, c, g, or t
  misc_feature (59370)..(59370): n is a, c, g, or t
  misc_feature (59377)..(59377): n is a, c, g, or t
  misc_feature (59385)..(59385): n is a, c, g, or t
  misc_feature (59403)..(59403): n is a, c, g, or t
  misc_feature (59406)..(59406): n is a, c, g, or t
  misc_feature (59408)..(59408): n is a, c, g, or t
  misc_feature (59412)..(59413): n is a, c, g, or t
  misc_feature (59420)..(59421): n is a, c, g, or t
  misc_feature (59423)..(59423): n is a, c, g, or t
  misc_feature (59427)..(59427): n is a, c, g, or t
  misc_feature (59430)..(59430): n is a, c, g, or t
  misc_feature (59451)..(59451): n is a, c, g, or t
  misc_feature (59455)..(59455): n is a, c, g, or t
  misc_feature (59457)..(59457): n is a, c, g, or t
  misc_feature (59460)..(59460): n is a, c, g, or t
  misc_feature (59475)..(59478): n is a, c, g, or t
  misc_feature (59482)..(59482): n is a, c, g, or t
  misc_feature (59484)..(59484): n is a, c, g, or t
  misc_feature (59494)..(59494): n is a, c, g, or t
  misc_feature (59502)..(59502): n is a, c, g, or t
  misc_feature (59507)..(59507): n is a, c, g, or t
  misc_feature (59534)..(59535): n is a, c, g, or t
  misc_feature (59542)..(59542): n is a, c, g, or t
  misc_feature (59544)..(59544): n is a, c, g, or t
  misc_feature (59551)..(59551): n is a, c, g, or t
  misc_feature (59556)..(59556): n is a, c, g, or t
  misc_feature (59569)..(59569): n is a, c, g, or t
  misc_feature (59585)..(59585): n is a, c, g, or t
  misc_feature (59591)..(59592): n is a, c, g, or t
  misc_feature (59594)..(59594): n is a, c, g, or t
  misc_feature (59596)..(59596): n is a, c, g, or t
  misc_feature (59598)..(59598): n is a, c, g, or t
  misc_feature (59607)..(59607): n is a, c, g, or t
  misc_feature (59617)..(59617): n is a, c, g, or t
  misc_feature (59622)..(59622): n is a, c, g, or t
  misc_feature (59627)..(59627): n is a, c, g, or t
  misc_feature (59631)..(59631): n is a, c, g, or t
  misc_feature (59643)..(59643): n is a, c, g, or t
  misc_feature (59649)..(59649): n is a, c, g, or t
  misc_feature (59658)..(59660): n is a, c, g, or t
  misc_feature (59665)..(59667): n is a, c, g, or t
  misc_feature (59676)..(59676): n is a, c, g, or t
  misc_feature (59695)..(59695): n is a, c, g, or t
  misc_feature (60082)..(60082): n is a, c, g, or t
  misc_feature (60087)..(60087): n is a, c, g, or t
  misc_feature (60092)..(60092): n is a, c, g, or t
  misc_feature (60096)..(60096): n is a, c, g, or t
  misc_feature (60108)..(60108): n is a, c, g, or t
  misc_feature (60114)..(60114): n is a, c, g, or t
  misc_feature (60123)..(60125): n is a, c, g, or t
  misc_feature (60130)..(60132): n is a, c, g, or t
  misc_feature (60141)..(60141): n is a, c, g, or t
  misc_feature (60160)..(60160): n is a, c, g, or t
  misc_feature (60191)..(60191): n is a, c, g, or t
  misc_feature (60194)..(60194): n is a, c, g, or t
  misc_feature (60200)..(60200): n is a, c, g, or t
  misc_feature (60235)..(60235): n is a, c, g, or t
  misc_feature (60238)..(60238): n is a, c, g, or t
  misc_feature (60240)..(60240): n is a, c, g, or t
  misc_feature (60243)..(60243): n is a, c, g, or t
  misc_feature (60249)..(60249): n is a, c, g, or t
  misc_feature (60265)..(60265): n is a, c, g, or t
  misc_feature (60271)..(60271): n is a, c, g, or t
  misc_feature (60275)..(60275): n is a, c, g, or t
  misc_feature (60280)..(60280): n is a, c, g, or t
  misc_feature (60282)..(60283): n is a, c, g, or t
  misc_feature (60287)..(60287): n is a, c, g, or t
  misc_feature (60298)..(60298): n is a, c, g, or t
  misc_feature (60300)..(60300): n is a, c, g, or t
  misc_feature (60303)..(60303): n is a, c, g, or t
  misc_feature (60310)..(60310): n is a, c, g, or t
  misc_feature (60318)..(60318): n is a, c, g, or t
  misc_feature (60336)..(60336): n is a, c, g, or t
  misc_feature (60339)..(60339): n is a, c, g, or t
  misc_feature (60341)..(60341): n is a, c, g, or t
  misc_feature (60345)..(60346): n is a, c, g, or t
  misc_feature (60353)..(60354): n is a, c, g, or t
  misc_feature (60356)..(60356): n is a, c, g, or t
  misc_feature (60360)..(60360): n is a, c, g, or t
  misc_feature (60363)..(60363): n is a, c, g, or t
  misc_feature (60384)..(60384): n is a, c, g, or t
  misc_feature (60388)..(60388): n is a, c, g, or t
  misc_feature (60390)..(60390): n is a, c, g, or t
  misc_feature (60393)..(60393): n is a, c, g, or t
  misc_feature (60408)..(60411): n is a, c, g, or t
  misc_feature (60415)..(60415): n is a, c, g, or t
  misc_feature (60417)..(60417): n is a, c, g, or t
  misc_feature (60427)..(60427): n is a, c, g, or t
  misc_feature (60435)..(60435): n is a, c, g, or t
  misc_feature (60440)..(60440): n is a, c, g, or t
  misc_feature (60467)..(60468): n is a, c, g, or t
  misc_feature (60475)..(60475): n is a, c, g, or t
  misc_feature (60477)..(60477): n is a, c, g, or t
  misc_feature (60484)..(60484): n is a, c, g, or t
  misc_feature (60489)..(60489): n is a, c, g, or t
  misc_feature (60502)..(60502): n is a, c, g, or t
  misc_feature (60518)..(60518): n is a, c, g, or t
  misc_feature (60524)..(60525): n is a, c, g, or t
  misc_feature (60527)..(60527): n is a, c, g, or t
  misc_feature (60529)..(60529): n is a, c, g, or t
  misc_feature (60531)..(60531): n is a, c, g, or t
  misc_feature (60540)..(60540): n is a, c, g, or t
  misc_feature (60550)..(60550): n is a, c, g, or t
  misc_feature (60555)..(60555): n is a, c, g, or t
  misc_feature (60560)..(60560): n is a, c, g, or t
  misc_feature (60564)..(60564): n is a, c, g, or t
  misc_feature (60576)..(60576): n is a, c, g, or t
  misc_feature (60582)..(60582): n is a, c, g, or t
  misc_feature (60591)..(60593): n is a, c, g, or t
  misc_feature (60598)..(60600): n is a, c, g, or t
  misc_feature (60609)..(60609): n is a, c, g, or t
  misc_feature (60628)..(60628): n is a, c, g, or t
  misc_feature (61018)..(61018): n is a, c, g, or t
  misc_feature (61023)..(61023): n is a, c, g, or t
  misc_feature (61028)..(61028): n is a, c, g, or t
  misc_feature (61032)..(61032): n is a, c, g, or t
  misc_feature (61044)..(61044): n is a, c, g, or t
  misc_feature (61050)..(61050): n is a, c, g, or t
  misc_feature (61059)..(61061): n is a, c, g, or t
  misc_feature (61066)..(61068): n is a, c, g, or t
  misc_feature (61077)..(61077): n is a, c, g, or t
  misc_feature (61096)..(61096): n is a, c, g, or t
  misc_feature (61127)..(61127): n is a, c, g, or t
  misc_feature (61130)..(61130): n is a, c, g, or t
  misc_feature (61136)..(61136): n is a, c, g, or t
  misc_feature (61171)..(61171): n is a, c, g, or t
  misc_feature (61174)..(61174): n is a, c, g, or t
  misc_feature (61176)..(61176): n is a, c, g, or t
  misc_feature (61179)..(61179): n is a, c, g, or t
  misc_feature (61185)..(61185): n is a, c, g, or t
  misc_feature (61201)..(61201): n is a, c, g, or t
  misc_feature (61207)..(61207): n is a, c, g, or t
  misc_feature (61211)..(61211): n is a, c, g, or t
  misc_feature (62620)..(62620): n is a, c, g, or t
  misc_feature (62622)..(62623): n is a, c, g, or t
  misc_feature (62627)..(62627): n is a, c, g, or t
  misc_feature (62638)..(62638): n is a, c, g, or t
  misc_feature (62640)..(62640): n is a, c, g, or t
  misc_feature (62643)..(62643): n is a, c, g, or t
  misc_feature (62650)..(62650): n is a, c, g, or t
  misc_feature (62658)..(62658): n is a, c, g, or t
  misc_feature (62676)..(62676): n is a, c, g, or t
  misc_feature (62679)..(62679): n is a, c, g, or t
  misc_feature (62681)..(62681): n is a, c, g, or t
  misc_feature (62685)..(62686): n is a, c, g, or t
  misc_feature (62693)..(62694): n is a, c, g, or t
  misc_feature (62696)..(62696): n is a, c, g, or t
  misc_feature (62700)..(62700): n is a, c, g, or t
  misc_feature (62703)..(62703): n is a, c, g, or t
  misc_feature (62724)..(62724): n is a, c, g, or t
aagcgttgcacaattcccccaacctccatacatacggcagctcttctagacacaggttttcccaggtcaaatgcggggaccccagccatatctcccaccctgagaaattttggagtttcagggagctcagaagctctgcagaggccaccctctctgaggggattcttcttagacctccatccagaggcaaatgttgacctgtccatgctgaaaccctcaggccttcctgggtcatcttctcccacccgctccttgatgacagggagcaggagcactaaagccacaccagaaatggattcaggactgacaggagccaccttgtcacctaagacatctacaggtgcaatcgtggtgacagaacatactctgccctttacttccccagataagaccttggccagtcctacatcttcggttgtgggaagaaccacccagtctttgggggtgatgtcctctgctctccctgagtcaacctctagaggaatgacacactccgagcaaagaaccagcccatcgctgagtccccaggtcaatggaactccctctaggaactaccctgctacaagcatggtttcaggattgagttccccaaggaccaggaccagttccacagaaggaaattttaccaaagaagcatctacatacacactcactgtagagaccacaagtggcccagtcactgagaagtacacagtccccactgagacctcaacaactgaaggtgacagcacagagaccccctgggacacaagatatattcctgtaaaaatcacatctccaatgaaaacatttgcagattcaactgcatccaaggaaaatgccccagtgtctatgactccagctgagaccacagttactgactcacatactccaggaaggacaaacccatcatttgggacactttattcttccttccttgacctatcacctaaagggaccccaaattccagaggtgaaacaagcctggaactgattctatcaaccactggatatcccttctcctctcctgaacctggctctgcaggacacagcagaataagtaccagtgcgcctttgtcatcatctgcttcagttctcgataataaaatatcagagaccagcatattctcaggccagagtctcacctcccctctgtctcctggggtgcccgaggccagagccagcacaatgcccaactcagctatccctttttccatgacactaagcaatgcagaaacaagtgccgaaagggtcagaagcacaatttcctctctggggactccatcaatatccacaaagcagacagcagagactatccttaccttccatgccttcgctgagaccatggatatacccagcacccacatagccaagactttggcttcagaatggttgggaagtccaggtacccttggtggcaccagcacttcagcgctgacaaccacatctccatctaccactttagtctcagaggagaccaacacccatcactccacgagtggaaaggaaacagaaggaactttgaatacatctatgactccacttgagacctctgctcctggagaagagtccgaaatgactgccaccttggtccccactctaggttttacaactcttgacagcaagatcagaagtccatctcaggtctcttcatcccacccaacaagagagctcagaaccacaggcagcacctctgggaggcagagttccagcacagctgcccacgggagctctgacatcctgagggcaaccacttccagcacctcaaaagcatcatcatggaccagtgaaagcacagctcagcaatttagtgaaccccagcacacacagtgggtggagacaagtcctagcatgaaaacagagagacccccagcatcaaccagtgtggcagcccctatcaccacttctgttccctcagtggtctctggcttcaccaccctgaagaccagctccacaaaagggatttggcttgaagaaacatctgcagacacactcatcggagaatccacagctggcccaaccacccatcagtttgctgttcccactgggatttcaatgacaggaggcagcagcaccaggggaagccagggcacaacccacctactcaccagagccacagcatcatctgagacatccgcagatttgactctggccacgaacggtgtcccagtctccgtgtctccagcagtgagcaagacggctgctggctcaagtcctccaggagggacaaagccatcatatacaatggtttcttctgtcatccctgagacatcatctctacagtcctcagctttcagggaaggaaccagcctgggactgactccattaaacactagacatcccttctcttcccctgaaccagactctgcaggacacaccaagataagcaccagcattcctctgttgtcatctgcttcagttcttgaggataaagtgtcagcgaccagcacattctcacaccacaaagccacctcatctattaccacagggactcctgaaatctcaacaaagacaaagcccagctcagccgttctttcctccatgaccctaagcaatgcagcaacaagtcctgaaagagtcagaaatgcaacttcccctctgactcatccatctccatcaggggaagagacagcagggagtgtcctcactctcagcacctctgctgagactacagactcacctaacatccacccaactgggacactgacttcagaatcgtcagagagtcctagcactctcagcctcccaagtgtctctggagtcaaaaccacattttcttcatctactccttccactcatctatttactagtggagaagaaacagaggaaacttcgaatccatctgtgtctcaacctgagacttctgtttccagagtaaggaccaccttggccagcacctctgtccctaccccagtattccccaccatggacacctggcctacacgttcagctcagttctcttcatcccacctagtgagtgagctcagagctacgagcagtacctcagttacaaactcaactggttcagctcttcctaaaatatctcacctcactgggacggcaacaatgtcacagaccaatagagacacgtttaatgactctgctgcaccccaaagcacaacttggccagagactagtcccagattcaagacagggttaccttcagcaacaaccactgtttcaacctctgccacttctctctctgctactgtaatggtctctaaattcacttctccagcaactagttccatggaagcaacttctatcagggaaccatcaacaaccatcctcacaacagagaccacgaatggcccaggctctatggctgtggcttctaccaacatcccaattggaaagggctacattactgaaggaagattggacacaagccatctgcccattggaaccacagcttcctctgagacatctatggattttaccatggccaaagaaagtgtctcaatgtcagtatctccatctcagtccatggatgctgctggctcaagcactccaggaaggacaagccaattcgttgacacattttctgatgatgtctatcatttaacatccagagaaattacaatacctagagatggaacaagctcagctctgactccacaaatgactgcaactcaccctccatctcctgatcctggctctgctagaagcacctggcttggcatcttgtcctcatctccttcttctcctactcccaaagtcacaatgagctccacattttcaactcagagagtcaccacaagcatgataatggacacagttgaaactagtcggtggaacatgcccaacttaccttccacgacttccctgacaccaagtaatattccaacaagtggtgccataggaaaaagcaccctggttcccttggacactccatctccagccacatcattggaggcatcagaagggggacttccaaccctcagcacctaccctgaatcaacaaacacacccagcatccacctcggagcacacgctagttcagaaagtccaagcaccatcaaacttaccatggcttcagtagtaaaacctggctcttacacacctctcaccttcccctcaatagagacccacattcatgtatcaacagccagaatggcttactcttctgggtcttcacctgagatgacagctcctggagagactaacactggtagtacctgggaccccaccacctacatcaccactacggatcctaaggatacaagttcagctcaggtctctacaccccactcagtgaggacactcagaaccacagaaaaccatccaaagacagagtccgccaccccagctgcttactctggaagtcctaaaatctcaagttcacccaatctcaccagtccggccacaaaagcatggaccatcacagacacaactgaacactccactcaattacattacacaaaattggcagaaaaatcatctggatttgagacacagtcagctccaggacctgtctctgtagtaatccctacctcccctaccattggaagcagcacattggaactaacttctgatgtcccaggggaacccctggtccttgctcccagtgagcagaccacaatcactctccccatggcaacatggctgagtaccagtttgacagaggaaatggcttcaacagaccttgatatttcaagtccaagttcacccatgagtacatttgctatttttccacctatgtccacaccttctcatgaactttcaaagtcagaggcagataccagtgccattagaaatacagattcaacaacgttggatcagcacctaggaatcaggagtttgggcagaactggggacttaacaactgttcctatcaccccactgacaaccacgtggaccagtgtgattgaacactcaacacaagcacaggacaccctttctgcaacgatgagtcctactcacgtgacacagtcactcaaagatcaaacatctataccagcctcagcatccccttcccatcttactgaagtctaccctgagctcgggacacaagggagaagctcctctgaggcaaccactttttggaaaccatctacagacacactgtccagagagattgagactggcccaacaaacattcaatccactccacccatggacaacacaacaacagggagcagtagtagtggagtcaccctgggcatagcccaccttcccataggaacatcctccccagctgagacatccacaaacatggcactggaaagaagaagttctacagccactgtctctatggctgggacaatgggactccttgttactagtgctccaggaagaagcatcagccagtcattaggaagagtttcctctgtcctttctgagtcaactactgaaggagtcacagattctagtaagggaagcagcccaaggctgaacacacagggaaatacagctctctcctcctctcttgaacccagctatgctgaaggaagccagatgagcacaagcatccctctaacctcatctcctacaactcctgatgtggaattcatagggggcagcacattttggaccaaggaggtcaccacagttatgacctcagacatctccaagtcttcagcaaggacagagtccagctcagctacccttatgtccacagctttgggaagcactgaaaatacaggaaaagaaaaactcagaactgcctctatggatcttccatctccaactccatcaatggaggtgacaccatggatttctctcactctcagtaatgcccccaataccacagattcacttgacctcagccatggggtgcacaccagctctgcagggactttggccactgacaggtcattgaatactggtgtcactagagcctccagattggaaaacggctctgatacctcttctaagtccctgtctatgggaaacagcactcacacttccatgactgacacagagaagagtgaagtgtcttcttcaatccatccccgacctgagacctcagctcctggagcagagaccactttgacttccactcctggaaacagggccataagcttaacattgcctttttcatccattccagtggaagaagtcatttctacaggcataacctcaggaccagacatcaactcagcacccatgacacattctcccatcaccccaccaacaattgtatggaccagtacaggcacaattgaacagtccactcaaccactacatgcagtttcttcagaaaaagtttctgtgcagacacagtcaactccatatgtcaactctgtggcagtgtctgcttcccctacccatgagaattcagtctcttctggaagcagcacatcctctccatattcctcagcctcacttgaatccttggattccacaatcagtaggaggaatgcaatcacttcctggctatgggacctcactacatctctccccactacaacttggccaagtactagtttatctgaggcactgtcctcaggccattctggggtttcaaacccaagttcaactacgactgaatttccactcttttcagctgcatccacatctgctgctaagcaaagaaatccagaaacagagacccatggtccccagaatacagccgcgagtactttgaacactgatgcatcctcggtcacaggtctttctgagactcctgtgggggcaagtatcagctctgaagtccctcttccaatggccataacttctagatcagatgtttctggccttacatctgagagtactgctaacccgagtttaggcacagcctcttcagcagggaccaaattaactaggacaatatccctgcccacttcagagtctttggtttcctttagaatgaacaaggatccatggacagtgtcaatccctttggggtcccatccaactactaatacagaaacaagcatcccagtaaacagcgcaggtccacctggcttgtccacagtagcatcagatgtaattgacacaccttcagatggggctgagagtattcccactgtctccttttccccctcccctgatactgaagtgacaactatctcacatttcccagaaaagacaactcattcatttagaaccatttcatctctcactcatgagttgacttcaagagtgacacctattcctggggattggatgagttcagctatgtctacaaagcccacaggagccagtccctccattacactgggagagagaaggacaatcacctctgctgctccaaccacttcccccatagttctcactgctagtttcacagagaccagcacagtttcactggataatgaaactacagtaaaaacctcagatatccttgacgcacggaaaacaaatgagctcccctcagatagcagttcttcttctgatctgatcaacacctccatagcttcttcaactatggatgtcactaaaacagcctccatcagtcccactagcatctcaggaatgacagcaagttcctccccatctctcttctcttcagatagaccccaggttcccacatctacaacagagacaaatacagccacctctccatctgtttccagtaacacctattctcttgatgggggctccaatgtgggtggcactccatccactttaccaccctttacaatcacccaccctgtcgagacaagctcggccctattagcctggtctagaccagtaagaactttcagcaccatggtcagcactgacactgcctccggagaaaatcctacctctagcaattctgtggtgacttctgttccagcaccaggtacatgggccagtgtaggcagtactactgacttacctgccatgggctttctcaagacaagtcctgcaggagaggcacactcacttctagcatcaactattgaaccagccactgccttcactccccatctctcagcagcagtggtcactggatccagtgctacatcagaagccagtcttctcactacgagtgaaagcaaagccattcattcttcaccacagaccccaactacacccacctctggagcaaactgggaaacttcagctactcctgagagccttttggtagtcactgagacttcagacacaacacttacctcaaagattttggtcacagataccatcttgttttcaactgtgtccacgccaccttctaaatttccaagtacggggactctgtctggagcttccttccctactttactcccggacactccagccatccctctcactgccactgagccaacaagttcattagctacatcctttgattccaccccactggtgactatagcttcggatagtcttggcacagtcccagagactaccctgaccatgtcagagacctcaaatggtgatgcactggttcttaagacagtaagtaacccagataggagcatccctggaatcactatccaaggagtaacagaaagtccactccatccttcttccacttccccctctaagattgttgctccacggaatacaacctatgaaggttcgatcacagtggcactttctactttgcctgcgggaactactggttcccttgtattcagtcagagttctgaaaactcagagacaacggctttggtagactcatcagctgggcttgagagggcatctgtgatgccactaaccacaggaagccagggtatggctagctctggaggaatcagaagtgggtccactcactcaactggaaccaaaacattttcttctctccctctgaccatgaacccaggtgaggttacagccatgtctgaaatcaccacgaacagactgacagctactcaatcaacagcacccaaagggatacctgtgaagcccaccagtgctgagtcaggcctcctaacacctgtctctgcctcctcaagcccatcaaaggcctttgcctcactgactacagctcccccatcaacttgggggatcccacagtctaccttgacatttgagttttctgaggtcccaagtttggatactaagtccgcttctttaccaactcctggacagtccctgaacaccattccagactcagatgcaagcacagcatcttcctcactgtccaagtctccagaaaaaaacccaagggcaaggatgatgacttccacaaaggccataagtgcaagctcatttcaatcaacaggttttactgaaacccctgagggatctgcctccccttctatggcagggcatgaacccagagtccccacttcaggaacaggggaccctagatatgcctcagagagcatgtcttatccagacccaagcaaggcatcatcagctatgacatcgacctctcttgcatcaaaactcacaactctcttcagcacaggtcaagcagcaaggtctggttctagttcctctcccataagcctatccactgagaaagaaacaagcttcctttcccccactgcatccacctccagaaagacttcactatttcttgggccttccatggcaaggcagcccaacatattggtgcatcttcagacttcagctctgacactttctccaacatccactctaaatatgtcccaggaggagcctcctgagttaacctcaagccagaccattgcagaagaagagggaacaacagctgaaacacagacgttaaccttcacaccatctgagaccccaacatccttgttacctgtctcttctcccacagaacccacagccagaagaaagagttctccagaaacatgggcaagctctatttcagttcctgccaagacctccttggttgaaacaactgatggaacgctagtgaccaccataaagatgtcaagccaggcagcacaaggaaattccacgtggcctgccccagcagaggagacggggaccagtccagcaggcacatccccaggaagcccagaagtgtctaccactctcaaaatcatgagctccaaggaacccagcatcagcccagagatcaggtccactgtgcgaaattctccttggaagactccagaaacaactgttcccatggagaccacagtggaaccagtcacccttcagtccacagccctaggaagtggcagcaccagcatctctcacctgcccacaggaaccacatcaccaaccaagtcaccaacagaaaatatgttggctacagaaagggtctccctctccccatccccacctgaggcttggaccaacctttattctggaactccaggagggaccaggcagtcactggccacaatgtcctctgtctccctagagtcaccaactgctagaagcatcacagggactggtcagcaaagcagtccagaactggtttcaaagacaactggaatggaattctctatgtggcatggctctactggagggaccacaggggacacacatgtctctctgagcacatcttccaatatccttgaagaccctgtaaccagcccaaactctgtgagctcattgacagataaatccaaacataaaaccgagacatgggtaagcaccacagccattccctccactgtcctgaataataagataatggcagctgaacaacagacaagtcgatctgtggatgaggcttattcatcaactagttcttggtcagatcagacatctgggagtgacatcacccttggtgcatctcctgatgtcacaaacacattatacatcacctccacagcacaaaccacctcactagtgtctctgccctctggagaccaaggcattacaagcctcaccaatccctcaggaggaaaaacaagctctgcgtcatctgtcacatctccttcaatagggcttgagactctgagggccaatgtaagtgcagtgaaaagtgacattgcccctactgctgggcatctatctcagacttcatctcctgcggaagtgagcatcctggacgtaaccacagctcctactccaggtatctccaccaccatcaccaccatgggaaccaactcaatctcaactaccacacccaacccagaagtgggtatgagtaccatggacagcaccccggccacagagaggcgcacaacttctacagaacacccttccacctggtcttccacagctgcatcagattcctggactgtcacagacatgacttcaaacttgaaagttgcaagatctcctggaacaatttccacaatgcatacaacttcattcttagcctcaagcactgaattagactccatgtctactccccatggccgtataactgtcattggaaccagcctggtcactccatcctctgatgcttcagctgtaaagacagagaccagtacaagtgaaagaacattgagtccttcagacacaactgcatctactcccatctcaactttttctcgtgtccagaggatgagcatctcagttcctgacattttaagtacaagttggactcccagtagtacagaagcagaagatgtgcctgtttcaatggtttctacagatcatgctagtacaaagactgacccaaatacgcccctgtccacttttctgtttgattctctgtccactcttgactgggacactgggagatctctgtcatcagccacagccactacctcagctcctcagggggccacaactccccaggaactcactttggaaaccatgatcagcccagctacctcacagttgcccttctctatagggcacattacaagtgcagtcacaccagctgcaatggcaaggagctctggagttactttttcaagaccagatcccacaagcaaaaaggcagagcagacttccactcagcttcccaccaccacttctgcacatccagggcaggtgcccagatcagcagcaacaactctggatgtgatcccacacacagcaaaaactccagatgcaacttttcagagacaagggcagacagctcttacaacagaggcaagagctacatctgactcctggaatgagaaagaaaaatcaaccccaagtgcaccttggatcactgagatgatgaattctgtctcagaagataccatcaaggaggttaccagctcctccagtgtattaaaggaccctgaatacgctggacataaacttggaatctgggacgacttcatccccaagtttggaaaagcagcccatatgagagagttgccccttctgagtccaccacaggacaaagaggcaattcacccttctacaaacacagtagagaccacaggctgggtcacaagttccgaacatgcttctcattccactatcccagcccactcagcgtcatccaaactcacatctccagtggttacaacctccaccagggaacaagcaatagtttctatgtcaacaaccacatggccagagtctacaagggctagaacagagcctaattccttcttgactattgaactgagggacgtcagcccttacatggacaccagctcaaccacacaaacaagtattatctcttccccaggttccactgcgatcaccaaggggcctagaacagaaattacctcctctaagagaatatccagctcattccttgcccagtctatgaggtcgtcagacagcccctcagaagccatcaccaggctgtctaactttcctgccatgacagaatctggaggaatgatccttgctatgcaaacaagtccacctggcgctacatcactaagtgcacctactttggatacatcagccacagcctcctggacagggactccactggctacgactcagagatttacatactcagagaagaccactctctttagcaaaggtcctgaggatacatcacagccaagccctccctctgtggaagaaaccagctcttcctcttccctggtacctatccatgctacaacctcgccttccaatattttgttgacatcacaagggcacagtccctcctctactccacctgtgacctcagttttcttgtctgagacctctggcctggggaagaccacagacatgtcgaggataagcttggaacctggcacaagtttacctcccaatttgagcagtacagcaggtgaggcgttatccacttatgaagcctccagagatacaaaggcaattcatcattctgcagacacagcagtgacgaatatggaggcaaccagttctgaatattctcctatcccaggccatacaaagccatccaaagccacatctccattggttacctcccacatcatgggggacatcacttcttccacatcagtatttggctcctccgagaccacagagattgagacagtgtcctctgtgaaccagggacttcaggagagaagcacatcccaggtggccagctctgctacagagacaagcactgtcattacccatgtgtctagtggtgatgctactactcatgtcaccaagacacaagccactttctctagcggaacatccatctcaagccctcatcagtttataacttctaccaacacatttacagatgtgagcaccaacccctccacctctctgataatgacagaatcttcaggagtgaccatcaccacccaaacaggtcctactggagctgcaacacagggtccatatctcttggacacatcaaccatgccttacttgacagagactccattagctgtgactccagattttatgcaatcagagaagaccactctcataagcaaaggtcccaaggatgtgacctggacaagccctccctctgtggcagaaaccagctatccctcttccctgacacctttcttggtcacaaccatacctcctgccacttccacgttacaagggcaacatacatcctctcctgtttctgcgacttcagttcttacctctggactggtgaagaccacagatatgttgaacacaagcatggaacctgtgaccaattcacctcaaaatttgaacaatccatcaaatgagatactggccactttggcagccaccacagatatagagactattcatccttccataaacaaagcagtgaccaatatggggactgccagttcagcacatgtactgcattccactctcccagtcagctcagaaccatctacagccacatctccaatggttcctgcctccagcatgggggacgctcttgcttctatatcaatacctggttctgagaccacagacattgagggagagccaacatcctccctgactgctggacgaaaagagaacagcaccctccaggagatgaactcaactacagagtcaaacatcatcctctccaatgtgtctgtgggggctattactgaagccacaaaaatggaagtcccctcttttgatgcaacattcataccaactcctgctcagtcaacaaagttcccagatattttctcagtagccagcagtagactttcaaactctcctcccatgacaatatctacccacatgaccaccacccagacagggtcttctggagctacatcaaagattccacttgccttagacacatcaaccttggaaacctcagcagggactccatcagtggtgactgaggggtttgcccactcaaaaataaccactgcaatgaacaatgatgtcaaggacgtgtcacagacaaaccctccctttcaggatgaagccagctctccctcttctcaagcacctgtccttgtcacaaccttaccttcttctgttgctttcacaccgcaatggcacagtacctcctctcctgtttctatgtcctcagttcttacttcttcactggtaaagaccgcaggcaaggtggatacaagcttagaaacagtgaccagttcacctcaaagtatgagcaacactttggatgacatatcggtcacttcagcagccaccacagatatagagacaacgcatccttccataaacacagtagttaccaatgtggggaccaccggttcagcatttgaatcacattctactgtctcagcttacccagagccatctaaagtcacatctccaaatgttaccacctccaccatggaagacaccacaatttcccgatcaatacctaaatcctctaagactacaagaactgagactgagacaacttcctccctgactcctaaactgagggagaccagcatctcccaggagatcacctcgtccacagagacaagcactgttccttacaaagagctcactggtgccactaccgaggtatccaggacagatgtcacttcctctagcagtacatccttccctggccctgatcagtccacagtgtcactagacatctccacagaaaccaacaccaggctgtctacctccccaataatgacagaatctgcagaaataaccatcaccacccaaacaggtcctcatggggctacatcacaggatacttttaccatggacccatcaaatacaaccccccaggcagggatccactcagctatgactcatggattttcacaattggatgtgaccactcttatgagcagaattccacaggatgtatcatggacaagtcctccctctgtggataaaaccagctccccctcttcctttctgtcctcacctgcaatgaccacaccttccctgatttcttctaccttaccagaggataagctctcctctcctatgacttcacttctcacctctggcctagtgaagattacagacatattacgtacacgcttggaacctgtgaccagctcacttccaaatttcagcagcacctcagataagatactggccacttctaaagacagtaaagacacaaaggaaatttttccttctataaacacagaagagaccaatgtgaaagccaacaactctggacatgaatcccattcccctgcactggctgactcagagacacccaaagccacaactcaaatggttatcaccaccactgtgggagatccagctccttccacatcaatgccagtgcatggttcctctgagactacaaacattaagagagagccaacatatttcttgactcctagactgagagagaccagtacctctcaggagtccagctttcccacggacacaagttttctactttccaaagtccccactggtactattactgaggtctccagtacaggggtcaactcttctagcaaaatttccaccccagaccatgataagtccacagtgccacctgacaccttcacaggagagatccccagggtcttcacctcctctattaagacaaaatctgcagaaatgacgatcaccacccaagcaagtcctcctgagtctgcatcgcacagtacccttcccttggacacatcaaccacactttcccagggagggactcattcaactgtgactcagggattcccatactcagaggtgaccactctcatgggcatgggtcctgggaatgtgtcatggatgacaactccccctgtggaagaaaccagctctgtgtcttccctgatgtcttcacctgccatgacatccccttctcctgtttcctccacatcaccacagagcatcccctcctctcctcttcctgtgactgcacttcctacttctgttctggtgacaaccacagatgtgttgggcacaacaagcccagagtctgtaaccagttcacctccaaatttgagcagcatcactcatgagagaccggccacttacaaagacactgcacacacagaagccgccatgcatcattccacaaacaccgcagtgaccaatgtagggacttccgggtctggacataaatcacaatcctctgtcctagctgactcagagacatcgaaagccacacctctgatgagtaccacctccaccctgggggacacaagtgtttccacatcaactcctaatatctctcagactaaccaaattcaaacagagccaacagcatccctgagccctagactgagggagagcagcacgtctgagaagaccagctcaacaacagagacaaatactgccttttcttatgtgcccacaggtgctattactcaggcctccagaacagaaatctcctctagcagaacatccatctcagaccttgatcggcccacaatagcacccgacatctccacaggaatgatcaccaggctcttcacctcccccatcatgacaaaatctgcagaaatgaccgtcaccactcaaacaactactcctggggctacatcacagggtatccttccttgggacacatcaaccacacttttccagggagggactcattcaaccgtgtctcagggattcccacactcagagataaccactcttcggagcagaacccctggagatgtgtcatggatgacaactccccctgtggaagaaaccagctctgggttttccctgatgtcaccttccatgacatccccttctcctgtttcctccacatcaccagagagcatcccctcctctcctctccctgtgactgcacttcttacttctgttctggtgacaaccaccaatgtattgggcacaacaagcccagagaccgtaacgagttcacctccaaatttaagcagccccacacaggagagactgaccacttacaaagacactgcgcacacagaagccatgcatgcttccatgcatacaaacactgcagtggccaacgtcgggacctccatttctggacatgaatcacaatcttctgtcccagctgattcacacacatccaaagccacatctccaatgggtatcaccttcgccatgggggatacaagtgtttctacatcaactcctgccttctttgagactagaattcagactgaatcaacatcctctttgattcctggattaagggacaccaggacgtctgaggagatcaacactgtgacagagaccagcactgtcctttcagaagtgcccactactactactactgaggtctccaggacagaagttatcacttccagcagaacaaccatctcagggcctgatcattccaaaatgtcaccctacatctccacagaaaccatcaccaggctctccacttttccttttgtaacaggatccacagaaatggccatcaccaaccaaacaggtcctatagggactatctcacaggctacccttaccctggacacatcaagcacagcttcctgggaagggactcactcacctgtgactcagagatttccacactcagaggagaccactactatgagcagaagtactaagggcgtgtcatggcaaagccctccctctgtggaagaaaccagttctccttcttccccagtgcctttacctgcaataacctcacattcatctctttattccgcagtatcaggaagtagccccacttctgctctccctgtgacttcccttctcacctctggcaggaggaagaccatagacatgttggacacacactcagaacttgtgaccagctccttaccaagtgcaagtagcttctcaggtgagatactcacttctgaagcctccacaaatacagagacaattcacttttcagagaacacagcagaaaccaatatggggaccaccaattctatgcataaactacattcctctgtctcaatccactcccagccatccggacacacacctccaaaggttactggatctatgatggaggacgctattgtttccacatcaacacctggttctcctgagactaaaaatgttgacagagactcaacatcccctctgactcctgaactgaaagaggacagcaccgccctggtgatgaactcaactacagagtcaaacactgttttctccagtgtgtccctggatgctgctactgaggtctccagggcagaagtcacctactatgatcctacattcatgccagcttctgctcagtcaacaaagtccccagacatttcacctgaagccagcagcagtcattctaactctcctcccttgacaatatctacacacaagaccatcgccacacaaacaggtccttctggggtgacatctcttggccaactgaccctggacacatcaaccatagccacctcagcaggaactccatcagccagaactcaggattttgtagattcagaaacaaccagtgtcatgaacaatgatctcaatgatgtgttgaagacaagccctttctctgcagaagaagccaactctctctcttctcaggcacctctccttgtgacaacctcaccttctcctgtaacttccacattgcaagagcacagtacctcctctcttgtttctgtgacctcagtacccacccctacactggcgaagatcacagacatggacacaaacttagaacctgtgactcgttcacctcaaaatttaaggaacaccttggccacttcagaagccaccacagatacacacacaatgcatccttctataaacacagcaatggccaatgtggggaccaccagttcaccaaatgaattctattttactgtctcacctgactcagacccatataaagccacatccgcagtagttatcacttccacctcgggggactcaatagtttccacatcaatgcctagatcctctgcgatgaaaaagattgagtctgagacaactttctccctgatatttagactgagggagactagcacctcccagaaaattggctcatcctcagacacaagcacggtctttgacaaagcattcactgctgctactactgaggtctccagaacagaactcacctcctctagcagaacatccatccaaggcactgaaaagcccacaatgtcaccggacacctccacaagatctgtcaccatgctttctacttttgctggcctgacaaaatccgaagaaaggaccattgccacccaaacaggtcctcatagggcgacatcacagggtacccttacctgggacacatcaatcacaacctcacaggcagggacccactcagctatgactcatggattttcacaattagatttgtccactcttacgagtagagttcctgagtacatatcagggacaagcccaccctctgtggaaaaaaccagctcttcctcttcccttctgtctttaccagcaataacctcaccgtcccctgtacctactacattaccagaaagtaggccgtcttctcctgttcatctgacttcactccccacctctggcctagtgaagaccacagatatgctggcatctgtggccagtttacctccaaacttgggcagcacctcacataagataccgactacttcagaagacattaaagatacagagaaaatgtatccttccacaaacatagcagtaaccaatgtggggaccaccacttctgaaaaggaatcttattcgtctgtcccagcctactcagaaccacccaaagtcacctctccaatggttacctctttcaacataagggacaccattgtttccacatccatgcctggctcctctgagattacaaggattgagatggagtcaacattctccgtggctcatgggctgaagggaaccagcacctcccaggaccccatcgtatccacagagaaaagtgctgtccttcacaagttgaccactggtgctactgagacctctaggacagaagttgcctcttctagaagaacatccattccaggccctgatcattccacagagtcaccagacatctccactgaagtgatccccagcctgcctatctcccttggcattacagaatcttcaaatatgaccatcatcactcgaacaggtcctcctcttggctctacatcacagggcacatttaccttggacacaccaactacatcctccagggcaggaacacactcgatggcgactcaggaatttccacactcagaaatgaccactgtcatgaacaaggaccctgagattctatcatggacaatccctccttctatagagaaaaccagcttctcctcttccctgatgccttcaccagccatgacttcacctcctgtttcctcaacattaccaaagaccattcacaccactccttctcctatgacctcactgctcacccctagcctagtgatgaccacagacacattgggcacaagcccagaacctacaaccagttcacctccaaatttgagcagtacctcacatgtgatactgacaacagatgaagacaccacagctatagaagccatgcatccttccacaagcacagcagcgactaatgtggaaaccacctgttctggacatgggtcacaatcctctgtcctaactgactcagaaaaaaccaaggccacagctccaatggataccacctccaccatggggcatacaactgtttccacatcaatgtctgtttcctctgagactacaaaaattaagagagagtcaacatattccttgactcctggactgagagagaccagcatttcccaaaatgccagcttttccactgacacaagtattgttctttcagaagtccccactggtactactgctgaggtctccaggacagaagtcacctcctctggtagaacatccatccctggcccttctcagtccacagttttgccagaaatatccacaagaacaatgacaaggctctttgcctcgcccaccatgacagaatcagcagaaatgaccatccccactcaaacaggtccttctgggtctacctcacaggatacccttaccttggacacatccaccacaaagtcccaggcaaagactcattcaactttgactcagagatttccacactcagagatgaccactctcatgagcagaggtcctggagatatgtcatggcaaagctctccctctctggaaaatcccagctctctcccttccctgctgtctttacctgccacaacctcacctcctcccatttcctccacattaccagtgactatctcctcctctcctcttcctgtgacttcacttctcacctctagcccggtaacgaccacagacatgttacacacaagcccagaacttgtaaccagttcacctccaaagctgagccacacttcagatgagagactgaccactggcaaggacaccacaaatacagaagctgtgcatccttccacaaacacagcagcgtccaatgtggagattcccagctttggacatgaatccccttcctctgccttagctgactcagagacatccaaagccacatcaccaatgtttattacctccacccaggaggatacaactgttgccatatcaacccctcacttcttggagactagcagaattcagaaagagtcaatttcctccctgagccctaaattgagggagacaggcagttctgtggagacaagctcagccatagagacaagtgctgtcctttctgaagtgtccattggtgctactactgagatctccaggacagaagtcacctcctctagcagaacatccatctctggttctgctgagtccacaatgttgccagaaatatccaccacaagaaaaatcattaagttccctacttcccccatcctggcagaatcatcagaaatgaccatcaagacccaaacaagtcctcctgggtctacatcagagagtacctttacattagacacatcaaccactccctccttggtaataacccattcgactatgactcagagattgccacactcagagataaccactcttgtgagtagaggtgctggggatgtgccacggcccagctctctccctgtggaagaaacaagccctccatcttcccagctgtctttatctgccatgatctcaccttctcctgtttcttccacattaccagcaagtagccactcctcttctgcttctgtgacttcacctctcacaccaggccaagtgaagactactgaggtgttggacgcaagtgcagaacctgaaaccagttcacctccaagtttgagcagcacctcagttgaaatactggccacctctgaagtcaccacagatacggagaaaattcatcctttcccaaacacggcagtaaccaaagttggaacttccagttctggacatgaatccccttcctctgtcctacctgactcagagacaaccaaagccacatcggcaatgggtaccatctccattatgggggatacaagtgtttctacattaactcctgccttatctaacactaggaaaattcagtcagagccagcttcctcactgaccaccagattgagggagaccagcacctctgaagagaccagcttagccacagaagcaaacactgttctttctaaagtgtccactggtgctactactgaggtctccaggacagaagccatctcctttagcagaacatccatgtcaggccctgagcagtccacaatgtcacaagacatctccataggaaccatccccaggatttctgcctcctctgtcctgacagaatctgcaaaaatgaccatcacaacccaaacaggtccttcggagtctacactagaaagtacccttaatttgaacacagcaaccacaccctcttgggtggaaacccactctatagtaattcagggatttccacacccagagatgaccacttccatgggcagaggtcctggaggtgtgtcatggcctagccctccctttgtgaaagaaaccagccctccatcctccccgctgtctttacctgccgtgacctcacctcatcctgtttccaccacattcctagcacatatccccccctctccccttcctgtgacttcacttctcacctctggcccggcgacaaccacagatatcttgggtacaagcacagaacctggaaccagttcatcttcaagtttgagcaccacctcccatgagagactgaccacttacaaagacactgcacatacagaagccgtgcatccttccacaaacacaggagggaccaatgtggcaaccaccagctctggatataaatcacagtcctctgtcctagctgactcatctccaatgtgtaccacctccaccatgggggatacaagtgttctcacatcaactcctgccttccttgagactaggaggattcagacagagctagcttcctccctgacccctggattgagggagtccagtggctctgaagggaccagctcaggcaccaagatgagcactgtcctctctaaagtgcccactggtgctactactgagatctccaaggaagacgtcacctccatcccaggtcccgctcaatccacaatatcaccagacatctccacaagaaccgtcagctggttctctacatcccctgtcatgacagaatcagcagaaataaccatgaacacccatacaagtcctttaggggccacaacacaaggcaccagtactttggccacgtcaagcacaacctctttgacaatgacacactcaactatatctcaaggattttcacactcacagatgagcactcttatgaggaggggtcctgaggatgtatcatggatgagccctccccttctggaaaaaactagaccttccttttctctgatgtcttcaccagccacaacttcaccttctcctgtttcctccacattaccagagagcatctcttcctctcctcttcctgtgacttcactcctcacgtctggcttggcaaaaactacagatatgttgcacaaaagctcagaacctgtaaccaactcacctgcaaatttgagcagcacctcagttgaaatactggccacctctgaagtcaccacagatacagagaaaactcatccttcttcaaacagaacagtgaccgatgtggggacctccagttctggacatgaatccacttcctttgtcctagctgactcacagacatccaaagtcacatctccaatggttattacctccaccatggaggatacgagtgtctccacatcaactcctggcttttttgagactagcagaattcagacagaaccaacatcctccctgacccttggactgagaaagaccagcagctctgaggggaccagcttagccacagagatgagcactgtcctttctggagtgcccactggtgccactgctgaagtctccaggacagaagtcacctcctctagcagaacatccatctcaggctttgctcagctcacagtgtcaccagagacttccacagaaaccatcaccagactccctacctccagcataatgacagaatcagcagaaatgatgatcaagacacaaacagatcctcctgggtctacaccagagagtactcatactgtggacatatcaacaacacccaactgggtagaaacccactcgactgtgactcagagattttcacactcagagatgaccactcttgtgagcagaagccctggtgatatgttatggcctagtcaatcctctgtggaagaaaccagctctgcctcttccctgctgtctctgcctgccacgacctcaccttctcctgtttcctctacattagtagaggatttcccttccgcttctcttcctgtgacttctcttctcacccctggcctggtgataaccacagacaggatgggcataagcagagaacctggaaccagttccacttcaaatttgagcagcacctcccatgagagactgaccactttggaagacactgtagatacagaagacatgcagccttccacacacacagcagtgaccaacgtgaggacctccatttctggacatgaatcacaatcttctgtcctatctgactcagagacacccaaagccacatctccaatgggtaccacctacaccatgggggaaacgagtgtttccatatccacttctgacttctttgagaccagcagaattcagatagaaccaacatcctccctgacttctggattgagggagaccagcagctctgagaggatcagctcagccacagagggaagcactgtcctttctgaagtgcccagtggtgctaccactgaggtctccaggacagaagtgatatcctctaggggaacatccatgtcagggcctgatcagttcaccatatcaccagacatctctactgaagcgatcaccaggctttctacttcccccattatgacagaatcagcagaaagtgccatcactattgagacaggttctcctggggctacatcagagggtaccctcaccttggacacctcaacaacaaccttttggtcagggacccactcaactgcatctccaggattttcacactcagagatgaccactcttatgagtagaactcctggagatgtgccatggccgagccttccctctgtggaagaagccagctctgtctcttcctcactgtcttcacctgccatgacctcaacttcttttttctccgcattaccagagagcatctcctcctctcctcatcctgtgactgcacttctcacccttggcccagtgaagaccacagacatgttgcgcacaagctcagaacctgaaaccagttcacctccaaatttgagcagcacctcagctgaaatattagccacgtctgaagtcaccaaagatagagagaaaattcatccctcctcaaacacacctgtagtcaatgtagggactgtgatttataaacatctatccccttcctctgttttggctgacttagtgacaacaaaacccacatctccaatggctaccacctccactctggggaatacaagtgtttccacatcaactcctgccttcccagaaactatgatgacacagccaacttcctccctgacttctggattaagggagatcagtacctctcaagagaccagctcagcaacagagagaagtgcttctctttctggaatgcccactggtgctactactaaggtctccagaacagaagccctctccttaggcagaacatccaccccaggtcctgctcaatccacaatatcaccagaaatctccacggaaaccatcactagaatttctactcccctcaccacgacaggatcagcagaaatgaccatcacccccaaaacaggtcattctggggcatcctcacaaggtacctttaccttggacacatcaagcagagcctcctggccaggaactcactcagctgcaactcacagatctccacactcagggatgaccactcctatgagcagaggtcctgaggatgtgtcatggccaagccgcccatcagtggaaaaaactagccctccatcttccctggtgtctttatctgcagtaacctcaccttcgccactttattccacaccatctgagagtagccactcatctcctctccgggtgacttctcttttcacccctgtcatgatgaagaccacagacatgttggacacaagcttggaacctgtgaccacttcacctcccagtatgaatatcacctcagatgagagtctggccacttctaaagccaccatggagacagaggcaattcagctttcagaaaacacagctgtgactcagatgggcaccatcagcgctagacaagaattctattcctcttatccaggcctcccagagccatccaaagtgacatctccagtggtcacctcttccaccataaaagacattgtttctacaaccatacctgcttcctctgagataacaagaattgagatggagtcaacatccaccctgacccccacaccaagggagaccagcacctcccaggagatccactcagccacaaagccaagcactgttccttacaaggcactcactagtgccacgattgaggactccatgacacaagtcatgtcctctagcagaggacctagccctgatcagtccacaatgtcacaagacatatccagtgaagtgatcaccaggctctctacctcccccatcaaggcagaatctacagaaatgaccattaccacccaaacaggttctcctggggctacatcaaggggtacccttaccttggacacttcaacaacttttatgtcagggacccactcaactgcatctcaaggattttcacactcacagatgaccgctcttatgagtagaactcctggagatgtgccatggctaagccatccctctgtggaagaagccagctctgcctctttctcactgtcttcacctgtcatgacctcatcttctcccgtttcttccacattaccagacagcatccactcttcttcgcttcctgtgacatcacttctcacctcagggctggtgaagaccacagagctgttgggcacaagctcagaacctgaaaccagttcacccccaaatttgagcagcacctcagctgaaatactggccaccactgaagtcactacagatacagagaaactggagatgaccaatgtggtaacctcaggttatacacatgaatctccttcctctgtcctagctgactcagtgacaacaaaggccacatcttcaatgggtatcacctaccccacaggagatacaaatgttctcacatcaacccctgccttctctgacaccagtaggattcaaacaaagtcaaagctctcactgactcctgggttgatggagaccagcatctctgaagagaccagctctgccacagaaaaaagcactgtcctttctagtgtgcccactggtgctactactgaggtctccaggacagaagccatctcttctagcagaacatccatcccaggccctgctcaatccacaatgtcatcagacacctccatggaaaccatcactagaatttctacccccctcacaaggaaagaatcaacagacatggccatcacccccaaaacaggtccttctggggctacctcgcagggtacctttaccttggactcatcaagcacagcctcctggccaggaactcactcagctacaactcagagatttccacagtcagtggtgacaactcctatgagcagaggtcctgaggatgtgtcatggccaagcccgctgtctgtggaaaaaaacagccctccatcttccctggtatcttcatcttcagtaacctcaccttcgccactttattccacaccatctgggagtagccactcctctcctgtccctgtcacttctcttttcacctctatcatgatgaaggccacagacatgttggatgcaagtttggaacctgagaccacttcagctcccaatatgaatatcacctcagatgagagtctggccacttctaaagccaccacggagacagaggcaattcacgtttttgaaaatacagcagcgtcccatgtggaaaccaccagtgctacagaggaactctattcctcttccccaggcttctcagagccaacaaaagtgatatctccagtggtcacctcttcctctataagagacaacatggtttccacaacaatgcctggctcctctggcattacaaggattgagatagagtcaatgtcatctctgacccctggactgagggagaccagaacctcccaggacatcacctcatccacagagacaagcactgtcctttacaagatgtcctctggtgccactcctgaggtctccaggacagaagttatgccctctagcagaacatccattcctggccctgctcagtccacaatgtcactagacatctccgatgaagttgtcaccaggctgtctacctctcccatcatgacagaatctgcagaaataaccatcaccacccaaacaggttattctctggctacatcccaggttacccttcccttgggcacctcaatgacctttttgtcagggacccactcaactatgtctcaaggactttcacactcagagatgaccaatcttatgagcaggggtcctgaaagtctgtcatggacgagccctcgctttgtggaaacaactagatcttcctcttctctgacatcattacctctcacgacctcactttctcctgtgtcctccacattactagacagtagcccctcctctcctcttcctgtgacttcacttatcctcccaggcctggtgaagactacagaagtgttggatacaagctcagagcctaaaaccagttcatctccaaatttgagcagcacctcagttgaaataccggccacctctgaaatcatgacagatacagagaaaattcatccttcctcaaacacagcggtggccaaagtgaggacctccagttctgttcatgaatctcattcctctgtcctagctgactcagaaacaaccataaccataccttcaatgggtatcacctccgctgtggacgataccactgttttcacatcaaatcctgccttctctgagactaggaggattccgacagagccaacattctcattgactcctggattcagggagactagcacctctgaagagaccacctcaatcacagaaacaagtgcagtcctttatggagtgcccactagtgctactactgaagtctccatgacagaaatcatgtcctctaatagaacacacatccctgactctgatcagtccacgatgtctccagacatcatcactgaagtgatcaccaggctctcttcctcatccatgatgtcagaatcaacacaaatgaccatcaccacccaaaaaagttctcctggggctacagcacagagtactcttaccttggccacaacaacagcccccttggcaaggacccactcaactgttcctcctagatttttacactcagagatgacaactcttatgagtaggagtcctgaaaatccatcatggaagagctctccctttgtggaaaaaactagctcttcatcttctctgttgtccttacctgtcacgacctcaccttctgtttcttccacattaccgcagagtatcccttcctcctctttttctgtgacttcactcctcaccccaggcatggtgaagactacagacacaagcacagaacctggaaccagtttatctccaaatctgagtggcacctcagttgaaatactggctgcctctgaagtcaccacagatacagagaaaattcatccttcttcaagcatggcagtgaccaatgtgggaaccaccagttctggacatgaactatattcctctgtttcaatccactcggagccatccaaggctacatacccagtgggtactccctcttccatggctgaaacctctatttccacatcaatgcctgctaattttgagaccacaggatttgaggctgagccattttctcatttgacttctggatttaggaagacaaacatgtccctggacaccagctcagtcacaccaacaaatacaccttcttctcctgggtccactcaccttttacagagttccaagactgatttcacctcttctgcaaaaacatcatccccagactggcctccagcctcacagtatactgaaattccagtggacataatcaccccctttaatgcttctccatctattacggagtccactgggataacctccttcccagaatccaggtttactatgtctgtaacagaaagtactcatcatctgagtacagatttgctgccttcagctgagactatttccactggcacagtgatgccttctctatcagaggccatgacttcatttgccaccactggagttccacgagccatctcaggttcaggtagtccattctctaggacagagtcaggccctggggatgctactctgtccaccattgcagagagcctgccttcatccactcctgtgccattctcctcttcaaccttcactaccactgattcttcaaccatcccagccctccatgagataacttcctcttcagctaccccatatagagtggacaccagtcttgggacagagagcagcactactgaaggacgcttggttatggtcagtactttggacacttcaagccaaccaggcaggacatcttcaacacccattttggataccagaatgacagagagcgttgagctgggaacagtgacaagtgcttatcaagttccttcactctcaacacggttgacaagaactgatggcattatggaacacatcacaaaaatacccaatgaagcagcacacagaggtaccataagaccagtcaaaggccctcagacatccacttcgcctgccagtcctaaaggactacacacaggagggacaaaaagaatggagaccaccaccacagctttgaagaccaccaccacagctttgaagaccacttccagagccaccttgaccaccagtgtctatactcccactttgggaacactgactcccctcaatgcatcaaggcaaatggccagcacaatcctcacagaaatgatgatcacaaccccatatgttttccctgatgttccagaaacgacatcctcattggctaccagcctgggagcagaaaccagcacagctcttcccaggacaaccccatctgttctcaatagagaatcagagaccacagcctcactggtctctcgttctggggcagagagaagtccggttattcaaactctagatgtttcttctagtgagccagatacaacagcttcatgggttatccatcctgcagagaccatcccaactgtttccaagacaacccccaattttttccacagtgaattagacactgtatcttccacagccaccagtcatggggcagacgtcagctcagccattccaacaaatatctcacctagtgaactagatgcactgaccccactggtcactatttcggggacagatactagtacaacattcccaacactgactaagtccccacatgaaacagagacaagaaccacatggctcactcatcctgcagagaccagctcaactattcccagaacaatccccaatttttctcatcatgaatcagatgccacaccttcaatagccaccagtcctggggcagaaaccagttcagctattccaattatgactgtctcacctggtgcagaagatctggtgacctcacaggtcactagttctgggacagacagaaatatgactattccaactttgactctttctcctggtgaaccaaagacgatagcctcattagtcacccatcctgaagcacagacaagttcggccattccaacttcaactatctcgcctgctgtatcacggttggtgacctcaatggtcaccagtttggcggcaaagacaagtacaactaatcgagctctgacaaactcccctggtgaaccagctacaacagtttcattggtcacgcatcctgcacagaccagcccaacagttccctggacaacttccatttttttccatagtaaatcagacaccacaccttcaatgaccaccagtcatggggcagaatccagttcagctgttccaactccaactgtttcaactgaggtaccaggagtagtgacccctttggtcaccagttctagggcagtgatcagtacaactattccaattctgactctttctcctggtgaaccagagaccacaccttcaatggccaccagtcatggggaagaagccagttctgctattccaactccaactgtttcacctggggtaccaggagtggtgacctctctggtcactagttctagggcagtgactagtacaactattccaattctgactttttctcttggtgaaccagagaccacaccttcaatggccaccagtcatgggacagaagctggctcagctgttccaactgttttacctgaggtaccaggaatggtgacctctctggttgctagttctagggcagtaaccagtacaactcttccaactctgactctttctcctggtgaaccagagaccacaccttcaatggccaccagtcatggggcagaagccagctcaactgttccaactgtttcacctgaggtaccaggagtggtgacctctctggtcactagttctagtggagtaaacagtacaagtattccaactctgattctttctcctggtgaactagaaaccacaccttcaatggccaccagtcatggggcagaagccagctcagctgttccaactccaactgtttcacctggggtatcaggagtggtgacccctctggtcactagttccagggcagtgaccagtacaactattccaattctaactctttcttctagtgagccagagaccacaccttcaatggccaccagtcatggggtagaagccagctcagctgttctaactgtttcacctgaggtaccaggaatggtgacctctctggtcactagttctagagcagtaaccagtacaactattccaactctgactatttcttctgatgaaccagagaccacaacttcattggtcacccattctgaggcaaagatgatttcagccattccaactttagctgtctcccctactgtacaagggctggtgacttcactggtcactagttctgggtcagagaccagtgcgttttcaaatctaactgttgcctcaagtcaaccagagaccatagactcatgggtcgctcatcctgggacagaagcaagttctgttgttccaactttgactgtctccactggtgagccgtttacaaatatctcattggtcacccatcctgcagagagtagctcaactcttcccaggacaacctcaaggttttcccacagtgaattagacactatgccttctacagtcaccagtcctgaggcagaatccagctcagccatttcaactactatttcacctggtataccaggtgtgctgacatcactggtcactagctctgggagagacatcagtgcaacttttccaacagtgcctgagtccccacatgaatcagaggcaacagcctcatgggttactcatcctgcagtcaccagcacaacagttcccaggacaacccctaattattctcatagtgaaccagacaccacaccatcaatagccaccagtcctggggcagaagccacttcagattttccaacaataactgtctcacctgatgtaccagatatggtaacctcacaggtcactagttctgggacagacaccagtataactattccaactctgactctttcttctggtgagccagagaccacaacctcatttatcacctattctgagacacacacaagttcagccattccaactctccctgtctcccctggtgcatcaaagatgctgacctcactggtcatcagttctgggacagacagcactacaactttcccaacactgacggagaccccatatgaaccagagacaacagccatacagctcattcatcctgcagagaccaacacaatggttcccaagacaactcccaagttttcccatagtaagtcagacaccacactcccagtagccatcaccagtcctgggccagaagccagttcagctgtttcaacgacaactatctcacctgatatgtcagatctggtgacctcactggtccctagttctgggacagacaccagtacaaccttcccaacattgagtgagaccccatatgaaccagagactacagtcacgtggctcactcatcctgcagaaaccagcacaacggtttctgggacaattcccaacttttcccataggggatcagacactgcaccctcaatggtcaccagtcctggagtagacacgaggtcaggtgttccaactacaaccatcccacccagtataccaggggtagtgacctcacaggtcactagttctgcaacagacactagtacagctattccaactttgactccttctcctggtgaaccagagaccacagcctcatcagctacccatcctgggacacagactggcttcactgttccaattcggactgttccctctagtgagccagatacaatggcttcctgggtcactcatcctccacagaccagcacacctgtttccagaacaacctccagtttttcccatagtagtccagatgccacacctgtaatggccaccagtcctaggacagaagccagttcagctgtactgacaacaatctcacctggtgcaccagagatggtgacttcacagatcactagttctggggcagcaaccagtacaactgttccaactttgactcattctcctggtatgccagagaccacagccttattgagcacccatcccagaacagggacaagtaaaacatttcctgcttcaactgtgtttcctcaagtatcagagaccacagcctcactcaccattagacctggtgcagagactagcacagctctcccaactcagacaacatcctctctcttcaccctacttgtaactggaaccagcagagttgatctaagtccaactgcttcacctggtgtttctgcaaaaacagccccactttccacccatccagggacagagaccagcacaatgattccaacttcaactctttcccttggtttactagagactacaggcttactggccaccagctcttcagcagagaccagcacgagtactctaactctgactgtttcccctgctgtctctgggctttccagtgcctctataacaactgataagccccaaactgtgacctcctggaacacagaaacctcaccatctgtaacttcagttggacccccagaattttccaggactgtcacaggcaccactatgaccttgataccatcagagatgccaacaccacctaaaaccagtcatggagaaggagtgagtccaaccactatcttgagaactacaatggttgaagccactaatttagctaccacaggttccagtcccactgtggccaagacaacaaccaccttcaatacactggctggaagcctctttactcctctgaccacacctgggatgtccaccttggcctctgagagtgtgacctcaagaacaagttataaccatcggtcctggatctccaccaccagcagttataaccgtcggtactggacccctgccaccagcactccagtgacttctacattctccccagggatttccacatcctccatccccagctccacagcagccacagtcccattcatggtgccattcaccctcaacttcaccatcaccaacctgcagtacgaggaggacatgcggcaccctggttccaggaagttcaacgccacagagagagaactgcagggtctgctcaaacccttgttcaggaatagcagtctggaatacctctattcaggctgcagactagcctcactcaggccagagaaggatagctcagccatggcagtggatgccatctgcacacatcgccctgaccctgaagacctcggactggacagagagcgactgtactgggagctgagcaatctgacaaatggcatccaggagctgggcccctacaccctggaccggaacagtctctatgtcaatggtttcacccatcgaagctctatgcccaccaccagcactcctgggacctccacagtggatgtgggaacctcagggactccatcctccagccccagccccacggctgctggccctctcctgatgccgttcaccctcaacttcaccatcaccaacctgcagtacgaggaggacatgcgtcgcactggctccaggaagttcaacaccatggagagtgtcctgcagggtctgctcaagcccttgttcaagaacaccagtgttggccctctgtactctggctgcagattgaccttgctcaggcccgagaaagatggggcagccactggagtggatgccatctgcacccaccgccttgaccccaaaagccctggactcaacagggagcagctgtactgggagctaagcaaactgaccaatgacattgaagagctgggcccctacaccctggacaggaacagtctctatgtcaatggtttcacccatcagagctctgtgtccaccaccagcactcctgggacctccacagtggatctcagaacctcagggactccatcctccctctccagccccacaattatggctgctggccctctcctggtaccattcaccctcaacttcaccatcaccaacctgcagtatggggaggacatgggtcaccctggctccaggaagttcaacaccacagagagggtcctgcagggtctgcttggtcccatattcaagaacaccagtgttggccctctgtactctggctgcagactgacctctctcaggtctgagaaggatggagcagccactggagtggatgccatctgcatccatcatcttgaccccaaaagccctggactcaacagagagcggctgtactgggagctgagccaactgaccaatggcatcaaagagctgggcccctacaccctggacaggaacagtctctatgtcaatggtttcacccatcggacctctgtgcccaccaccagcactcctgggacctccacagtggaccttggaacctcagggactccattctccctcccaagccccgcaactgctggccctctcctggtgctgttcaccctcaacttcaccatcaccaacctgaagtatgaggaggacatgcatcgccctggctccaggaagttcaacaccactgagagggtcctgcagactctgcttggtcctatgttcaagaacaccagtgttggccttctgtactctggctgcagactgaccttgctcaggtccgagaaggatggagcagccactggagtggatgccatctgcacccaccgtcttgaccccaaaagccctggactggacagagagcagctatactgggagctgagccagctgaccaatggcatcaaagagctgggcccctacaccctggacaggaacagtctctatgtcaatggtttcacccattggatccctgtgcccaccagcagcactcctgggacctccacagtggaccttgggtcagggactccatcctccctccccagccccacagctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtggaccttgggacctcagggactccatcctccctccccagccctacatcngctggccctctcctggtnccnttcaccctcaacttcaccatcaccaacctgcagtacgaggaggacatgcggcacccnggntccaggaagttcaacaccacngagagggtnctgcagggtctgctnaagcccctnttcaagagcaccagtgttggccctctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtggaccttgggacctcagggactccatcctccctccccagccctacatctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccactggaatggatgccatctgcagccaccgtcttgaccccaaaagccctggactcaacagagagcagctgtactgggagctgagccagctgacccatggcatcaaagagctgggcccctacaccctggacaggaacagtctctatgtcaatggtttcacccatcggagctctgtggcccccaccagcactcctgggacctccacagtggaccttgggacctcagggactccatcctccctccccagccccacaacagctgttcctctcctggtgccgttcaccctcaactttaccatcaccaatctgcagtatggggaggacatgcgtcaccctggctccaggaagttcaacaccacagagagggtcctgcagggtctgcttggtcccttgttcaagaactccagtgtcggccctctgtactctggctgcagactgatctctctcaggtctgagaaggatggggcagccactggagtggatgccatctgcacccaccaccttaaccctcaaagccctggactggacagggagcagctgtactggcagctgagccagatgaccaatggcatcaaagagctgggcccctacaccctggaccggaacagtctctacgtcaatggtttcacccatcggagctctgggctcaccaccagcactccttggacttccacagttgaccttggaacctcagggactccatcccccgtccccagccccacaactgctggccctctcctggtgccattcaccctcaacttcaccatcaccaacctgcagtatgaggaggacatgcatcgccctggatctaggaagttcaacaccacagagagggtcctgcagggtctgcttagtcccattttcaagaactccagtgttggccctctgtactctggctgcagactgacctctctcaggcccgagaaggatggggcagcaactggaatggatgctgtctgcctctaccaccctaatcccaaaagacctggactggacagagagcagctgtactgggagctaagccagctgacccacaacatcactgagctgggcccctacagcctggacagggacagtctctatgtcaatggtttcacccatcagaactctgtgcccaccaccagtactcctgggacctccacagtgtactgggcaaccactgggactccatcctccttccccggccacacagagcctggccctctcctgataccattcactttcaactttaccatcaccaacctgcattatgaggaaaacatgcaacaccctggttccaggaagttcaacaccacggagagggttctgcagggtctgctcaagcccttgttcaagaacaccagtgttggccctctgtactctggctgcagactgacctctctcaggcccgagaaggatggggcagcaactggaatggatgctgtctgcctctaccaccctaatcccaaaagacctgggctggacagagagcagctgtactgggagctaagccagctgacccacaacatcactgagctgggcccctacagcctggacagggacagtctctatgtcaatggtttcacccatcagaactctgtgcccaccaccagtactcctgggacctccacagtgtactgggcaaccactgggactccatcctccttccccggccacacagagcctggccctctcctgataccattcactttcaactttaccatcaccaacctgcattatgaggaaaacatgcaacaccctggttccaggaagttcaacaccacggagagggttctgcagggtctgctcaagcccttgttcaagaacaccagtgttggccctctgtactctggctgcagactgaccttgctcagacctgagaagcatgaggcagccactggagtggacaccatctgtacccaccgcgttgatcccatcggacctggactggacagggagcggctatactgggagctgagccagctgaccaacagcattaccgaactgggaccctacaccctggacagggacagtctctatgtcaatggcttcaaccctcggagctctgtgccaaccaccagcactcctgggacctccacagtgcacctggcaacctctgggactccatcctccctgcctggccacacagcccctgtccctctcttgataccattcaccctcaactttaccatcaccaacctgcattatgaggaaaacatgcaacaccctggttccaggaagttcaacaccacggagagggttctgcagggtctgctcaagcccttgttcaagaacaccagtgttggccctctgtactctggctgcagactgaccttgctcagacctgagaagcatgaggcagccactggagtggacaccatctgtacccaccgcgttgatcccatcggacctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacatctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccactggaatggatgccatctgcagccaccgtcttgaccccaaaagccctggactcgacagagagcagctgtactgggagctgagccagctgacccatggcatcaaagagctgggcccctacaccctggacaggaacagtctctatgtcaatggtttcacccatcggagctctgtggcccccaccagcactcctgggacctccacagtggaccttgggacctcagggactccatcctccctccccagccccacaacagctgttcctctcctggtgccgttcaccctcaactttaccatcaccaatctgcagtatggggaggacatgcgtcaccctggctccaggaagttcaacaccacagagagggtcctgcagggtctgcttggtcccttgttcaagaactccagtgtcggccctctgtactctggctgcagactgatctctctcaggtctgagaaggatggggcagccactggagtggatgccatctgcacccaccaccttaaccctcaaagccctggactggacagggagcagctgtactggcagctgagccagatgaccaatggcatcaaagagctgggcccctacaccctggaccggaacagtctctacgtcaatggtttcacccatcggagctctgggctcaccaccagcactccttggacttccacagttgaccttggaacctcagggactccatcccccgtccccagccccacaactgctggccctctcctggtgccattcaccctaaacttcaccatcaccaacctgcagtatgaggaggacatgcatcgccctggatctaggaagttcaacgccacagagagggtcctgcagggtctgcttagtcccatattcaagaactccagtgttggccctctgtactctggctgcagactgacctctctcaggcccgagaaggatggggcagcaactggaatggatgctgtctgcctctaccaccctaatcccaaaagacctggactggacagagagcagctgtactgggagctaagccagctgacccacaacatcactgagctgggcccctacagcctggacagggacagtctctatgtcaatggtttcacccatcagagctctatgacgaccaccagaactcctgatacctccacaatgcacctggcaacctcgagaactccagcctccctgtctggacctacgaccgccagccctctcctggtgctattcacaatcaactgcaccatcaccaacctgcagtacgaggaggacatgcgtcgcactggctccaggaagttcaacaccatggagagtgtcctgcagggtctgctcaagcccttgttcaagaacaccagtgttggccctctgtactctggctgcagattgaccttgctcaggcccaagaaagatggggcagccactggagtggatgccatctgcacccaccgccttgaccccaaaagccctggactcaacagggagcagctgtactgggagctaagcaaactgaccaatgacattgaagagctgggcccctacaccctggacaggaacagtctctatgtcaatggtttcacccatcagagctctgtgtccaccaccagcactcctgggacctccacagtggatctcagaacctcagggactccatcctccctctccagccccacaattatgncnnctgnccctctcctgntnccnttcaccntcaacttnaccatcaccaacctgcantangnggannacatgcnncncccnggntccaggaagttcaacaccacngagagggtcctacagggtctgctcaggcccttgttcaagaacaccagtgtcagctctctgtactctggttgcagactgaccttgctcaggcctgagaaggatggggcagccaccagagtggatgctgcctgcacctaccgccctgatcccaaaagccctggactggacagagagcaactatactgggagctgagccagctaacccacagcatcactgagctgggaccctacaccctggacagggtcagtctctatgtcaatggcttcaaccctcggagctctgtgccaaccaccagcactcctgggacctccacagtgcacctggcaacctctgggactccatcctccctgcctggccacacancnnctgnccctctcctgntnccnttcaccntcaacttnaccatcaccaacctgcantangnggannacatgcnncncccnggntccaggaagttcaacaccacngagagggttctgcagggtctgctcaaacccttgttcaggaatagcagtctggaatacctctattcaggctgcagactagcctcactcaggccagagaaggatagctcagccatggcagtggatgccatctgcacacatcgccctgaccctgaagacctcggactggacagagagcgactgtactgggagctgagcaatctgacaaatggcatccaggagctgggcccctacaccctggaccggaacagtctctacgtcaatggtttcacccatcggagctctgggctcaccaccagcactccttggacttccacagttgaccttggaacctcagggactccatcccccgtccccagccccacaactgctggccctctcctggtgccattcaccctcaacttcaccatcaccaacctgcagtatgaggaggacatgcatcgccctggttccaggaggttcaacaccacggagagggttctgcagggtctgctcacgcccttgttcaagaacaccagtgttggccctctgtactctggctgcagactgaccttgctcagacctgagaagcaagaggcagccactggagtggacaccatctgtacccaccgcgttgatcccatcggacctggactggacagagagcggctatactgggagctgagccagctgaccaacagcatcacagagctgggaccctacaccctggatagggacagtctctatgtcaatggcttcaacccttggagctctgtgccaaccaccagcactcctgggacctccacagtgcacctggcaacctctgggactccatcctccctgcctggccacacagcccctgtccctctcttgataccattcaccctcaactttaccatcaccgacctgcattatgaagaaaacatgcaacaccctggttccaggaagttcaacaccacggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcgttacagagctgggcccctacaccctggacagggacagtctctatgtcaatggcttcacccatcggagctctgtgccaaccaccagtattcctgggacctctgcagtgcacctggaaacctctgggactccagcctccctccctggccacacagcccctggccctctcctggtgccattcaccctcaacttcactatcaccaacctgcagtatgaggaggacatgcgtcaccctggttccaggaagttcagcaccacggagagagtcctgcagggtctgctcaagcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacctacgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccacgctcaggcccaagaaggatggggcagccaccaaagtggatgccatctgcacctaccgccctgatcccaaaagccctggactggacagagagcagctatactgggagctgagccagctaacccacagcatcactgagctgggcccctacacccaggacagggacagtctctatgtcaatggcttcacccatcggagctctgtgccaaccaccagtattcctgggacctctgcagtgcacctggaaacctctgggactccagcctccctccctggccacacagcccctggccctctcctggtgccattcaccctcaacttcactatcaccaacctgcagtatgaggaggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaacccaggactggacagagagcagctatactgggagctgagcaaactgacccgtggcatcatcgagctgggcccctacctcctggacagaggcagtctctatgtcaatggtttcacccatcggacctctgtgcccaccaccagcactcctgggacctccacagtggaccttggaacctcagggactccattctccctcccaagccccgcancnnctgnccctctcctgntnccnttcaccntcaacttnaccatcaccaacctgcantangnggannacatgcnncncccnggntccaggaagttcaacaccacngagagggtcctgcagactctgcttggtcctatgttcaagaacaccagtgttggccttctgtactctggctgcagactgaccttgctcaggtccgagaaggatggagcagccactggagtggatgccatctgcacccaccgtcttgaccccaaaagccctggagtggacagggagcaactatactgggagctgagccagctgaccaatggcattaaagaactgggcccctacaccctggacaggaacagtctctatgtcaatgggttcacccattggatccctgtgcccaccagcagcactcctgggacctccacagtggaccttgggtcagggactccatcctccctccccagccccacaactgctggccctctcctggtgccgttcaccctcaacttcaccatcaccaacctgaagtacgaggaggacatgcattgccctggctccaggaagttcaacaccacagagagagtcctgcagagtctgcttggtcccatgttcaagaacaccagtgttggccctctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtggaccttgggacctcagggactccatcctccctccccagccctacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccattggatccctgtgcccaccagcagcactcctgggacctccacagtggaccttgggtcagggactccatcctccctccccagccccacaactgctggccctctcctggtgccgttcaccctcaacttcaccatcaccaacctgaagtacgaggaggacatgcattgccctggctccaggaagttcaacaccacagagagagtcctgcagagtctgcttggtcccatgttcaagaacaccagtgttggccctctgtactctggctgcagactgacctcgctcaggtccgagaaggatggagcagccactggagtggatgccatctgcacccaccgtgttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtgnacntnggnacctcngggactccatcctccntccccngccncacatctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcaaccactggaatggatgccatctgcacccaccgtcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagagggttctgcagggtctgctcaaacccttgttcaggaatagcagtctggaatacctctattcaggctgcagactagcctcactcaggccagagaaggatagctcagccatggcagtggatgccatctgcacacatcgccctgaccctgaagacctcggactggacagagagcgactgtactgggagctgagcaatctgacaaatggcatccaggagctgggcccctacaccctggaccggaacagtctctatgtcaatggtttcacccatcgaagctctatgcccaccaccagcactcctgggacctccacagtggatgtgggaacctcagggactccatcctccagccccagccccacgactgctggccctctcctgataccattcaccctcaacttcaccatcaccaacctgcagtatggggaggacatgggtcaccctggctccaggaagttcaacaccacagagagggtcctgcagggtctgcttggtcccatattcaagaacaccagtgttggccctctgtactctggctgcagactgacctctctcaggtctgagaaggatggagcagccactggagtggatgccatctgcatccatcatcttgaccccaaaagccctggactcaacagagagcggctgtactgggagctgagccaactgaccaatggcatcaaagagctgggcccctacaccctggacaggaacagtctctatgtcaatggtttcacccatcggacctctgtgcccaccaccagcactcctgggacctccacagtggaccttggaacctcagggactccattctccctcccaagccccgcaactgctggccctctcctggtgctgttcaccctcaacttcaccatcaccaacctgaagtatgaggaggacatgcatcgccctggctccaggaagttcaacaccactgagagggtcctgcagactctgcttggtcctatgttcaagaacaccagtgttggccttctgtactctggctgcagactgaccttgctcaggtccgagaaggatggagcagccactggagtggatgccatctgcacccaccgtcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctaacccacagcatcactgagctgggcccctacacccaggacagggacagtctctatgtcaatggcttcacccatcggagctctgtgccaaccaccagtattcctgggacctctgcagtgcacctggaaaccactgggactccatcctccttccccggccacacagagcctggccctctcctgataccattcactttcaactttaccatcaccaacctgcgttatgaggaaaacatgcaacaccctggttccaggaagttcaacaccacggagagggttctgcagggtctgctcacgcccttgttcaagaacaccagtgttggccctctgtactctggctgcagactgaccttgctcagacctgagaagcaggaggcagccactggagtggacaccatctgtacccaccgcgttgatcccatcggacctggactggacagagagcggctatactgggagctgagccagctgaccaacagcatcacagagctgggaccctacaccctggatagggacagtctctatgtcgatggcttcaacccttggagctctgtgccaaccaccagcactcctgggacctccacagtgcacctggcaacctctgggactccatcccccctgcctggccacacagcccctgtccctctcttgataccattcaccctcaactttaccatcaccgacctgcattatgaagaaaacatgcaacaccctggttccaggaagttcaacaccacggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcatcacagagctgggaccctacaccctggatagggacagtctctatgtcaatggcttcaacccttggagctctgtgccaaccaccagcactcctgggacctccacagtgcacctggcaacctctgggactccatcctccctgcctggccacacaactgctggccctctcctggtgccgttcaccctcaacttcaccatcaccaacctgaagtacgaggaggacatgcattgccctggctccaggaagttcaacaccacagagagagtcctgcagagtctgcatggtcccatgttcaagaacaccagtgttggccctctgtactctggctgcagactgaccttgctcaggtccgagaaggatggagcagccactggagtggatgccatctgcacccaccgtcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaacagcatcacagagctgggaccctacaccctggatagggacagtctctatgtcaatggtttcacccatcgaagctctatgcccaccaccagtattcctgggacctctgcagtgcacctggaaacctctgggactccagcctccctccctggccacacagcccctggccctctcctggtgccattcaccctcaacttcactatcaccaacctgcagtatgaggaggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaaccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggttttcaccctcggagctctgtgccaaccaccagcactcctgggacctccacagtgcacctggcaacctctgggactccatcctccctgcctggccacacagcccctgtccctctcttgataccattcaccctcaactttaccatcaccaacctgcattatgaagaaaacatgcaacaccctggttccaggaagttcaacaccacggagcgggtcctgcagggtctgcttggtcccatgttcaagaacacaagtgtcggccttctgtactctggctgcagactgaccttgctcaggcctgagaagaatggggcagccactggaatggatgccatctgcagccaccgtcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcagaactctgtgcccaccaccagtactcctgggacctccacagtgtactgggcaaccactgggactccatcctccttccccggccacacagagcctggccctctcctgataccattcactttcaactttaccatcaccaacctgcattatgaggaaaacatgcaacaccctggttccaggaagttcaacaccacggagagggttctgcagggtctgctcacgcccttgttcaagaacaccagtgttggccctctgtactctggctgcagactgaccttgctcagacctgagaagcaggaggcagccactggagtggacaccatctgtacccaccgcgttgatcccatcggacctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcggagctctgtgccaaccaccagcagtcctgggacctccacagtgcacctggcaacctctgggactccatcctccctgcctggccacacagcccctgtccctctcttgataccattcaccctcaactttaccatcaccaacctgcattatgaagaaaacatgcaacaccctggttccaggaagttcaacaccacggagagggttctgcagggtctgctcaagcccttgttcaagagcaccagtgttggccctctgtactctggctgcagactgaccttgctcagacctgagaaacatggggcagccactggagtggacgccatctgcaccctccgccttgatcccactggtcctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcggacctctgtgcccaccaccagcactcctgggacctccacagtgcacctggcaacctctgggactccatcctccctgcctggccacacagcccctgtccctctcttgataccattcaccctcaactttaccatcaccaacctgcagtatgaggaggacatgcatcgccctggatctaggaagttcaacaccacagagagggtcctgcagggtctgcttagtcccattttcaagaactccagtgttggccctctgtactctggctgcagactgacctctctcaggcccgagaaggatggggcagcaactggaatggatgctgtctgcctctaccaccctaatcccaaaagacctgggctggacagagagcagctgtactgcgagctaagccagctgacccacaacatcactgagctgggcccctacagcctggacagggacagtctctatgtcaatggtttcacccatcagaactctgtgcccaccaccagtactcctgggacctccacagtgtactgggcaaccactgggactccatcctccttccccggccacacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccattggagctctgggctcaccaccagcactccttggacttccacagttgaccttggaacctcagggactccatcccccgtccccagccccacaactgctggccctctcctggtgccattcaccctaaacttcaccatcaccaacctgcagtatgaggaggacatgcatcgccctggatctaggaagttcaacgccacagagagggtcctgcagggtctgcttagtcccatattcaagaacaccagtgttggccctctgtactctggctgcagactgaccttgctcagacctgagaagcaggaggcagccactggagtggacaccatctgtacccaccgcgttgatcccatcggacctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcggagctttgggctcaccaccagcactccttggacttccacagttgaccttggaacctcagggactccatcccccgtccccagccccacaactgctggccctctcctggtgccattcaccctaaacttcaccatcaccaacctgcagtatgaggaggacatgcatcgccctggctccaggaagttcaacaccacggagagggtccttcagggtctgcttacgcccttgttcaggaacaccagtgtcagctctctgtactctggttgcagactgaccttgctcaggcctgagaaggatggggcagccaccagagtggatgctgtctgcacccatcgtcctgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccattggatccctgtgcccaccagcagcactcctgggacctccacagtggaccttgggtcagggactccatcctccctccccagccccacaactgctggccctctcctggtaccattcaccctcaacttcaccatcaccaacctgcagtatggggaggacatgggtcaccctggctccaggaagttcaacaccacagagagggtcctgcagggtctgcttggtcccatattcaagaacaccagtgttggccctctgtactctggctgcagactgacctctctcaggtccgagaaggatggagcagccactggagtggatgccatctgcatccatcatcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcagacctttgcgcccaacaccagcactcctgggacctccacagtggaccttgggacctcagggactccatcctccctccccagccctacatctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccaccagagtggatgctgtctgcacccatcgtcctgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacagcccctgtccctctcttgataccattcaccctcaactttaccatcaccaacctgcattatgaagaaaacatgcaacaccctggttccaggaagttcaacaccacggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcgttacagagctgggcccctacaccctggacagggacagtctctatgtcaatggcttcacccagcggagctctgtgccaaccaccagtattcctgggacctctgcagtgcacctggaaacctctgggactccagcctccctccctggccacacagcccctggccctctcctggtgccattcaccctcaacttcactatcaccaacctgcagtatgaggtggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaaccctggactggacagagagcagctatactgggagctgagcaaactgacccgtggcatcatcgagctgggcccctacctcctggacagaggcagtctctatgtcaatggtttcacccatcggaactttgtgcccatcaccagcactcctgggacctccacagtacacctaggaacctctgaaactccatcctccctacctagacccatagtgcctggccctctcctggtgccattcaccctcaacttcaccatcaccaacttgcagtatgaggaggccatgcgacaccctggctccaggaagttcaataccacggagagggtcctacagggtctgctcaggcccttgttcaagaataccagtatcggccctctgtactccagctgcagactgaccttgctcaggccagagaaggacaaggcagccaccagagtggatgccatctgtacccaccaccctgaccctcaaagccctggactgaacagagagcagctgtactgggagctgagccagctgacccacggcatcactgagctgggcccctacaccctggacagggacagtctctatgtcgatggtttcactcattggagccccataccgaccaccagcactcctgggacctccatagtgaacctgggaacctctgggatcccaccttccctccctgaaactacancnnctgnccctctcctgntnccnttcaccntcaacttnaccatcaccaacctgcantangnggannacatgcnncncccnggntccaggaagttcaacaccacngagagggttctgcagggtctgctcaagcccttgttcaagagcaccagtgttggccctctgtattctggctgcagactgaccttgctcaggcctgagaaggacggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccacagccactggccctgtcctgctgccattcaccctcaattttaccatcactaacctgcagtatgaggaggacatgcatcgccctggctccaggaagttcaacaccacggagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacctacgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctaacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggccactatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctccaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgaagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtctagatgagcctcctacaactcccaagccagccaccacattcctgcctcctctgtcagaagccacaacagccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggactcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcggaaaaaaaaaaaaaaa

SEQ ID NO: 315 - protein, 22152 aa, Homo sapiens
  misc_feature (13880)..(13880): Xaa can be any naturally occurring amino acid
  misc_feature (13887)..(13887): Xaa can be any naturally occurring amino acid
  misc_feature (13890)..(13891): Xaa can be any naturally occurring amino acid
  misc_feature (13893)..(13893): Xaa can be any naturally occurring amino acid
  misc_feature (13899)..(13899): Xaa can be any naturally occurring amino acid
  misc_feature (13903)..(13903): Xaa can be any naturally occurring amino acid
  misc_feature (13911)..(13918): Xaa can be any naturally occurring amino acid
  misc_feature (13926)..(13926): Xaa can be any naturally occurring amino acid
  misc_feature (13928)..(13928): Xaa can be any naturally occurring amino acid
  misc_feature (13930)..(13930): Xaa can be any naturally occurring amino acid
  misc_feature (13936)..(13938): Xaa can be any naturally occurring amino acid
  misc_feature (13940)..(13941): Xaa can be any naturally occurring amino acid
  misc_feature (14569)..(14571): Xaa can be any naturally occurring amino acid
  misc_feature (14575)..(14575): Xaa can be any naturally occurring amino acid
  misc_feature (14587)..(14587): Xaa can be any naturally occurring amino acid
  misc_feature (14591)..(14591): Xaa can be any naturally occurring amino acid
  misc_feature (14593)..(14594): Xaa can be any naturally occurring amino acid
  misc_feature (14725)..(14727): Xaa can be any naturally occurring amino acid
  misc_feature (14731)..(14731): Xaa can be any naturally occurring amino acid
  misc_feature (14743)..(14743): Xaa can be any naturally occurring amino acid
  misc_feature (14747)..(14747): Xaa can be any naturally occurring amino acid
  misc_feature (14749)..(14750): Xaa can be any naturally occurring amino acid
  misc_feature (15661)..(15663): Xaa can be any naturally occurring amino acid
  misc_feature (15667)..(15667): Xaa can be any naturally occurring amino acid
  misc_feature (15679)..(15679): Xaa can be any naturally occurring amino acid
  misc_feature (15683)..(15683): Xaa can be any naturally occurring amino acid
  misc_feature (15685)..(15686): Xaa can be any naturally occurring amino acid
  misc_feature (15972)..(15974): Xaa can be any naturally occurring amino acid
  misc_feature (15978)..(15978): Xaa can be any naturally occurring amino acid
  misc_feature (15990)..(15990): Xaa can be any naturally occurring amino acid
  misc_feature (15994)..(15994): Xaa can be any naturally occurring amino acid
  misc_feature (15996)..(15997): Xaa can be any naturally occurring amino acid
  misc_feature (16015)..(16015): Xaa can be any naturally occurring amino acid
  misc_feature (16017)..(16017): Xaa can be any naturally occurring amino acid
  misc_feature (16020)..(16020): Xaa can be any naturally occurring amino acid
  misc_feature (16025)..(16025): Xaa can be any naturally occurring amino acid
  misc_feature (16037)..(16037): Xaa can be any naturally occurring amino acid
  misc_feature (16040)..(16041): Xaa can be any naturally occurring amino acid
  misc_feature (16045)..(16045): Xaa can be any naturally occurring amino acid
  misc_feature (16048)..(16049): Xaa can be any naturally occurring amino acid
  misc_feature (16051)..(16054): Xaa can be any naturally occurring amino acid
  misc_feature (16057)..(16058): Xaa can be any naturally occurring amino acid
  misc_feature (16065)..(16065): Xaa can be any naturally occurring amino acid
  misc_feature (16072)..(16072): Xaa can be any naturally occurring amino acid
  misc_feature (16075)..(16076): Xaa can be any naturally occurring amino acid
  misc_feature (16078)..(16078): Xaa can be any naturally occurring amino acid
  misc_feature (16084)..(16084): Xaa can be any naturally occurring amino acid
  misc_feature (16088)..(16088): Xaa can be any naturally occurring amino acid
  misc_feature (16376)..(16376): Xaa can be any naturally occurring amino acid
  misc_feature (16383)..(16383): Xaa can be any naturally occurring amino acid
  misc_feature (16386)..(16387): Xaa can be any naturally occurring amino acid
  misc_feature (16389)..(16389): Xaa can be any naturally occurring amino acid
  misc_feature (16395)..(16395): Xaa can be any naturally occurring amino acid
  misc_feature (16399)..(16399): Xaa can be any naturally occurring amino acid
  misc_feature (16407)..(16414): Xaa can be any naturally occurring amino acid
  misc_feature (16422)..(16422): Xaa can be any naturally occurring amino acid
  misc_feature (16424)..(16424): Xaa can be any naturally occurring amino acid
  misc_feature (16426)..(16426): Xaa can be any naturally occurring amino acid
  misc_feature (16432)..(16434): Xaa can be any naturally occurring amino acid
  misc_feature (16436)..(16437): Xaa can be any naturally occurring amino acid
  misc_feature (16439)..(16441): Xaa can be any naturally occurring amino acid
  misc_feature (16445)..(16445): Xaa can be any naturally occurring amino acid
  misc_feature (16457)..(16457): Xaa can be any naturally occurring amino acid
  misc_feature (16461)..(16461): Xaa can be any naturally occurring amino acid
  misc_feature (16463)..(16464): Xaa can be any naturally occurring amino acid
  misc_feature (16844)..(16844): Xaa can be any naturally occurring amino acid
  misc_feature (16851)..(16851): Xaa can be any naturally occurring amino acid
  misc_feature (16854)..(16855): Xaa can be any naturally occurring amino acid
  misc_feature (16857)..(16857): Xaa can be any naturally occurring amino acid
  misc_feature (16863)..(16863): Xaa can be any naturally occurring amino acid
  misc_feature (16867)..(16867): Xaa can be any naturally occurring amino acid
  misc_feature (16875)..(16882): Xaa can be any naturally occurring amino acid
  misc_feature (16890)..(16890): Xaa can be any naturally occurring amino acid
  misc_feature (16892)..(16892): Xaa can be any naturally occurring amino acid
  misc_feature (16894)..(16894): Xaa can be any naturally occurring amino acid
  misc_feature (16900)..(16902): Xaa can be any naturally occurring amino acid
  misc_feature (16904)..(16905): Xaa can be any naturally occurring amino acid
  misc_feature (16907)..(16909): Xaa can be any naturally occurring amino acid
  misc_feature (16913)..(16913): Xaa can be any naturally occurring amino acid
  misc_feature (16925)..(16925): Xaa can be any naturally occurring amino acid
  misc_feature (16929)..(16929): Xaa can be any naturally occurring amino acid
  misc_feature (16931)..(16932): Xaa can be any naturally occurring amino acid
  misc_feature (17468)..(17468): Xaa can be any naturally occurring amino acid
  misc_feature (17475)..(17475): Xaa can be any naturally occurring amino acid
  misc_feature (17478)..(17479): Xaa can be any naturally occurring amino acid
  misc_feature (17481)..(17481): Xaa can be any naturally occurring amino acid
  misc_feature (17487)..(17487): Xaa can be any naturally occurring amino acid
  misc_feature (17491)..(17491): Xaa can be any naturally occurring amino acid
  misc_feature (17499)..(17506): Xaa can be any naturally occurring amino acid
  misc_feature (17514)..(17514): Xaa can be any naturally occurring amino acid
  misc_feature (17516)..(17516): Xaa can be any naturally occurring amino acid
  misc_feature (17518)..(17518): Xaa can be any naturally occurring amino acid
  misc_feature (17524)..(17526): Xaa can be any naturally occurring amino acid
  misc_feature (17528)..(17529): Xaa can be any naturally occurring amino acid
  misc_feature (17531)..(17533): Xaa can be any naturally occurring amino acid
  misc_feature (17537)..(17537): Xaa can be any naturally occurring amino acid
  misc_feature (17549)..(17549): Xaa can be any naturally occurring amino acid
  misc_feature (17553)..(17553): Xaa can be any naturally occurring amino acid
  misc_feature (17555)..(17556): Xaa can be any naturally occurring amino acid
  misc_feature (17574)..(17574): Xaa can be any naturally occurring amino acid
  misc_feature (17576)..(17576): Xaa can be any naturally occurring amino acid
  misc_feature (17579)..(17579): Xaa can be any naturally occurring amino acid
  misc_feature (17584)..(17584): Xaa can be any naturally occurring amino acid
  misc_feature (17596)..(17596): Xaa can be any naturally occurring amino acid
  misc_feature (17599)..(17600): Xaa can be any naturally occurring amino acid
  misc_feature (17604)..(17604): Xaa can be any naturally occurring amino acid
  misc_feature (17607)..(17608): Xaa can be any naturally occurring amino acid
  misc_feature (17610)..(17613): Xaa can be any naturally occurring amino acid
  misc_feature (17616)..(17617): Xaa can be any naturally occurring amino acid
  misc_feature (17624)..(17624): Xaa can be any naturally occurring amino acid
  misc_feature (17631)..(17631): Xaa can be any naturally occurring amino acid
  misc_feature (17780)..(17780): Xaa can be any naturally occurring amino acid
  misc_feature (17787)..(17787): Xaa can be any naturally occurring amino acid
  misc_feature (17790)..(17791): Xaa can be any naturally occurring amino acid
  misc_feature (17793)..(17793): Xaa can be any naturally occurring amino acid
  misc_feature (17799)..(17799): Xaa can be any naturally occurring amino acid
  misc_feature (17803)..(17803): Xaa can be any naturally occurring amino acid
  misc_feature (17811)..(17818): Xaa can be any naturally occurring amino acid
  misc_feature (17826)..(17826): Xaa can be any naturally occurring amino acid
  misc_feature (17828)..(17828): Xaa can be any naturally occurring amino acid
  misc_feature (17830)..(17830): Xaa can be any naturally occurring amino acid
  misc_feature (17836)..(17838): Xaa can be any naturally occurring amino acid
  misc_feature (17840)..(17841): Xaa can be any naturally occurring amino acid
  misc_feature (17843)..(17845): Xaa can be any naturally occurring amino acid
  misc_feature (17849)..(17849): Xaa can be any naturally occurring amino acid
  misc_feature (17861)..(17861): Xaa can be any naturally occurring amino acid
  misc_feature (17865)..(17865): Xaa can be any naturally occurring amino acid
  misc_feature (17867)..(17868): Xaa can be any naturally occurring amino acid
  misc_feature (17886)..(17886): Xaa can be any naturally occurring amino acid
  misc_feature (17888)..(17888): Xaa can be any naturally occurring amino acid
  misc_feature (17891)..(17891): Xaa can be any naturally occurring amino acid
  misc_feature (17896)..(17896): Xaa can be any naturally occurring amino acid
  misc_feature (17908)..(17908): Xaa can be any naturally occurring amino acid
  misc_feature (17911)..(17912): Xaa can be any naturally occurring amino acid
  misc_feature (17916)..(17916): Xaa can be any naturally occurring amino acid
  misc_feature (17919)..(17920): Xaa can be any naturally occurring amino acid
  misc_feature (17922)..(17925): Xaa can be any naturally occurring amino acid
  misc_feature (17928)..(17929): Xaa can be any naturally occurring amino acid
  misc_feature (17936)..(17936): Xaa can be any naturally occurring amino acid
  misc_feature (17943)..(17943): Xaa can be any naturally occurring amino acid
  misc_feature (17946)..(17947): Xaa can be any naturally occurring amino acid
  misc_feature (17949)..(17949): Xaa can be any naturally occurring amino acid
  misc_feature (17955)..(17955): Xaa can be any naturally occurring amino acid
  misc_feature (17959)..(17959): Xaa can be any naturally occurring amino acid
  misc_feature (18092)..(18092): Xaa can be any naturally occurring amino acid
  misc_feature (18099)..(18099): Xaa can be any naturally occurring amino acid
  misc_feature (18102)..(18103): Xaa can be any naturally occurring amino acid
  misc_feature (18105)..(18105): Xaa can be any naturally occurring amino acid
  misc_feature (18111)..(18111): Xaa can be any naturally occurring amino acid
  misc_feature (18115)..(18115): Xaa can be any naturally occurring amino acid
  misc_feature (18123)..(18130): Xaa can be any naturally occurring amino acid
  misc_feature (18138)..(18138): Xaa can be any naturally occurring amino acid
  misc_feature (18140)..(18140): Xaa can be any naturally occurring amino acid
  misc_feature (18142)..(18142): Xaa can be any naturally occurring amino acid
  misc_feature (18148)..(18150): Xaa can be any naturally occurring amino acid
  misc_feature (18152)..(18153): Xaa can be any naturally occurring amino acid
  misc_feature (18155)..(18157): Xaa can be any naturally occurring amino acid
  misc_feature (18161)..(18161): Xaa can be any naturally occurring amino acid
  misc_feature (18173)..(18173): Xaa can be any naturally occurring amino acid
  misc_feature (18177)..(18177): Xaa can be any naturally occurring amino acid
  misc_feature (18179)..(18180): Xaa can be any naturally occurring amino acid
  misc_feature (18198)..(18198): Xaa can be any naturally occurring amino acid
  misc_feature (18200)..(18200): Xaa can be any naturally occurring amino acid
  misc_feature (18203)..(18203): Xaa can be any naturally occurring amino acid
  misc_feature (18208)..(18208): Xaa can be any naturally occurring amino acid
  misc_feature (18220)..(18220): Xaa can be any naturally occurring amino acid
  misc_feature (18223)..(18224): Xaa can be any naturally occurring amino acid
  misc_feature (18228)..(18228): Xaa can be any naturally occurring amino acid
  misc_feature (18231)..(18232): Xaa can be any naturally occurring amino acid
  misc_feature (18234)..(18237): Xaa can be any naturally occurring amino acid
  misc_feature (18240)..(18241): Xaa can be any naturally occurring amino acid
  misc_feature (18248)..(18248): Xaa can be any naturally occurring amino acid
  misc_feature (18255)..(18255): Xaa can be any naturally occurring amino acid
  misc_feature (18258)..(18259): Xaa can be any naturally occurring amino acid
  misc_feature (18261)..(18261): Xaa can be any naturally occurring amino acid
  misc_feature (18267)..(18267): Xaa can be any naturally occurring amino acid
  misc_feature (18271)..(18271): Xaa can be any naturally occurring amino acid
  misc_feature (18404)..(18404): Xaa can be any naturally occurring amino acid
  misc_feature (18411)..(18411): Xaa can be any naturally occurring amino acid
  misc_feature (18414)..(18415): Xaa can be any naturally occurring amino acid
  misc_feature (18417)..(18417): Xaa can be any naturally occurring amino acid
  misc_feature (18423)..(18423): Xaa can be any naturally occurring amino acid
  misc_feature (18427)..(18427): Xaa can be any naturally occurring amino acid
  misc_feature (18435)..(18442): Xaa can be any naturally occurring amino acid
  misc_feature (18450)..(18450): Xaa can be any naturally occurring amino acid
  misc_feature (18452)..(18452): Xaa can be any naturally occurring amino acid
  misc_feature (18454)..(18454): Xaa can be any naturally occurring amino acid
  misc_feature (18460)..(18462): Xaa can be any naturally occurring amino acid
  misc_feature (18464)..(18465): Xaa can be any naturally occurring amino acid
  misc_feature (18467)..(18469): Xaa can be any naturally occurring amino acid
  misc_feature (18473)..(18473): Xaa can be any naturally occurring amino acid
  misc_feature (18485)..(18485): Xaa can be any naturally occurring amino acid
  misc_feature (18489)..(18489): Xaa can be any naturally occurring amino acid
  misc_feature (18491)..(18492): Xaa can be any naturally occurring amino acid
  misc_feature (18510)..(18510): Xaa can be any naturally occurring amino acid
  misc_feature (18512)..(18512): Xaa can be any naturally occurring amino acid
  misc_feature (18515)..(18515): Xaa can be any naturally occurring amino acid
  misc_feature (18520)..(18520): Xaa can be any naturally occurring amino acid
  misc_feature (18532)..(18532): Xaa can be any naturally occurring amino acid
  misc_feature (18535)..(18536): Xaa can be any naturally occurring amino acid
  misc_feature (18540)..(18540): Xaa can be any naturally occurring amino acid
  misc_feature (18543)..(18544): Xaa can be any naturally occurring amino acid
  misc_feature (18546)..(18549): Xaa can be any naturally occurring amino acid
  misc_feature (18552)..(18553): Xaa can be any naturally occurring amino acid
  misc_feature (18560)..(18560): Xaa can be any naturally occurring amino acid
  misc_feature (18567)..(18567): Xaa can be any naturally occurring amino acid
  misc_feature (18570)..(18571): Xaa can be any naturally occurring amino acid
  misc_feature (18573)..(18573): Xaa can be any naturally occurring amino acid
  misc_feature (18579)..(18579): Xaa can be any naturally occurring amino acid
  misc_feature (18583)..(18583): Xaa can be any naturally occurring amino acid
  misc_feature (18716)..(18716): Xaa can be any naturally occurring amino acid
  misc_feature (18723)..(18723): Xaa can be any naturally occurring amino acid
  misc_feature (18726)..(18727): Xaa can be any naturally occurring amino acid
  misc_feature (18729)..(18729): Xaa can be any naturally occurring amino acid
  misc_feature (18735)..(18735): Xaa can be any naturally occurring amino acid
  misc_feature (18739)..(18739): Xaa can be any naturally occurring amino acid
  misc_feature (18747)..(18754): Xaa can be any naturally occurring amino acid
  misc_feature (18762)..(18762): Xaa can be any naturally occurring amino acid
  misc_feature (18764)..(18764): Xaa can be any naturally occurring amino acid
  misc_feature (18766)..(18766): Xaa can be any naturally occurring amino acid
  misc_feature (18772)..(18774): Xaa can be any naturally occurring amino acid
  misc_feature (18776)..(18777): Xaa can be any naturally occurring amino acid
  misc_feature (18779)..(18781): Xaa can be any naturally occurring amino acid
  misc_feature (18785)..(18785): Xaa can be any naturally occurring amino acid
  misc_feature (18797)..(18797): Xaa can be any naturally occurring amino acid
  misc_feature (18801)..(18801): Xaa can be any naturally occurring amino acid
  misc_feature (18803)..(18804): Xaa can be any naturally occurring amino acid
  misc_feature (18822)..(18822): Xaa can be any naturally occurring amino acid
  misc_feature (18824)..(18824): Xaa can be any naturally occurring amino acid
  misc_feature (18827)..(18827): Xaa can be any naturally occurring amino acid
  misc_feature (18832)..(18832): Xaa can be any naturally occurring amino acid
  misc_feature (18844)..(18844): Xaa can be any naturally occurring amino acid
  misc_feature (18847)..(18848): Xaa can be any naturally occurring amino acid
  misc_feature (18852)..(18852): Xaa can be any naturally occurring amino acid
  misc_feature (18855)..(18856): Xaa can be any naturally occurring amino acid
  misc_feature (18858)..(18861): Xaa can be any naturally occurring amino acid
  misc_feature (18864)..(18865): Xaa can be any naturally occurring amino acid
  misc_feature (18872)..(18872): Xaa can be any naturally occurring amino acid
  misc_feature (18879)..(18879): Xaa can be any naturally occurring amino acid
  misc_feature (18882)..(18883): Xaa can be any naturally occurring amino acid
  misc_feature (18885)..(18885): Xaa can be any naturally occurring amino acid
  misc_feature (18891)..(18891): Xaa can be any naturally occurring amino acid
  misc_feature (18895)..(18895): Xaa can be any naturally occurring amino acid
  misc_feature (19091)..(19093): Xaa can be any naturally occurring amino acid
  misc_feature (19097)..(19097): Xaa can be any naturally occurring amino acid
  misc_feature (19109)..(19109): Xaa can be any naturally occurring amino acid
  misc_feature (19113)..(19113): Xaa can be any naturally occurring amino acid
  misc_feature (19115)..(19116): Xaa can be any naturally occurring amino acid
  misc_feature (19134)..(19134): Xaa can be any naturally occurring amino acid
  misc_feature (19136)..(19136): Xaa can be any naturally occurring amino acid
  misc_feature (19139)..(19139): Xaa can be any naturally occurring amino acid
  misc_feature (19144)..(19144): Xaa can be any naturally occurring amino acid
  misc_feature (19156)..(19156): Xaa can be any naturally occurring amino acid
  misc_feature (19159)..(19160): Xaa can be any naturally occurring amino acid
  misc_feature (19164)..(19164): Xaa can be any naturally occurring amino acid
  misc_feature (19167)..(19168): Xaa can be any naturally occurring amino acid
  misc_feature (19170)..(19173): Xaa can be any naturally occurring amino acid
  misc_feature (19176)..(19177): Xaa can be any naturally occurring amino acid
  misc_feature (19184)..(19184): Xaa can be any naturally occurring amino acid
  misc_feature (19191)..(19191): Xaa can be any naturally occurring amino acid
  misc_feature (19194)..(19195): Xaa can be any naturally occurring amino acid
  misc_feature (19197)..(19197): Xaa can be any naturally occurring amino acid
  misc_feature (19203)..(19203): Xaa can be any naturally occurring amino acid
  misc_feature (19207)..(19207): Xaa can be any naturally occurring amino acid
  misc_feature (19340)..(19340): Xaa can be any naturally occurring amino acid
  misc_feature (19347)..(19347): Xaa can be any naturally occurring amino acid
  misc_feature (19350)..(19351): Xaa can be any naturally occurring amino acid
  misc_feature (19353)..(19353): Xaa can be any naturally occurring amino acid
  misc_feature (19359)..(19359): Xaa can be any naturally occurring amino acid
  misc_feature (19363)..(19363): Xaa can be any naturally occurring amino acid
  misc_feature (19371)..(19378): Xaa can be any naturally occurring amino acid
  misc_feature (19386)..(19386): Xaa can be any naturally occurring amino acid
  misc_feature (19388)..(19388): Xaa can be any naturally occurring amino acid
  misc_feature (19390)..(19390): Xaa can be any naturally occurring amino acid
  misc_feature (19396)..(19398): Xaa can be any naturally occurring amino acid
  misc_feature (19400)..(19401): Xaa can be any naturally occurring amino acid
  misc_feature (19403)..(19405): Xaa can be any naturally occurring amino acid
  misc_feature (19409)..(19409): Xaa can be any naturally occurring amino acid
  misc_feature (19421)..(19421): Xaa can be any naturally occurring amino acid
  misc_feature (19425)..(19425): Xaa can be any naturally occurring amino acid
  misc_feature (19427)..(19428): Xaa can be any naturally occurring amino acid
  misc_feature (19446)..(19446): Xaa can be any naturally occurring amino acid
  misc_feature (19448)..(19448): Xaa can be any naturally occurring amino acid
  misc_feature (19451)..(19451): Xaa can be any naturally occurring amino acid
  misc_feature (19456)..(19456): Xaa can be any naturally occurring amino acid
  misc_feature (19468)..(19468): Xaa can be any naturally occurring amino acid
  misc_feature (19471)..(19472): Xaa can be any naturally occurring amino acid
  misc_feature (19476)..(19476): Xaa can be any naturally occurring amino acid
  misc_feature (19479)..(19480): Xaa can be any naturally occurring amino acid
  misc_feature (19482)..(19485): Xaa can be any naturally occurring amino acid
  misc_feature (19488)..(19489): Xaa can be any naturally occurring amino acid
  misc_feature (19496)..(19496): Xaa can be any naturally occurring amino acid
  misc_feature (19503)..(19503): Xaa can be any naturally occurring amino acid
  misc_feature (19506)..(19507): Xaa can be any naturally occurring amino acid
  misc_feature (19509)..(19509): Xaa can be any naturally occurring amino acid
  misc_feature (19515)..(19515): Xaa can be any naturally occurring amino acid
  misc_feature (19519)..(19519): Xaa can be any naturally occurring amino acid
  misc_feature (19652)..(19652): Xaa can be any naturally occurring amino acid
  misc_feature (19659)..(19659): Xaa can be any naturally occurring amino acid
  misc_feature (19662)..(19663): Xaa can be any naturally occurring amino acid
  misc_feature (19665)..(19665): Xaa can be any naturally occurring amino acid
  misc_feature (19671)..(19671): Xaa can be any naturally occurring amino acid
  misc_feature (19675)..(19675): Xaa can be any naturally occurring amino acid
  misc_feature (19683)..(19690): Xaa can be any naturally occurring amino acid
  misc_feature (19698)..(19698): Xaa can be any naturally occurring amino acid
  misc_feature (19700)..(19700): Xaa can be any naturally occurring amino acid
  misc_feature (19702)..(19702): Xaa can be any naturally occurring amino acid
  misc_feature (19708)..(19710): Xaa can be any naturally occurring amino acid
  misc_feature (19712)..(19713): Xaa can be any naturally occurring amino acid
  misc_feature (19715)..(19717): Xaa can be any naturally occurring amino acid
  misc_feature (19721)..(19721): Xaa can be any naturally occurring amino acid
  misc_feature (19733)..(19733): Xaa can be any naturally occurring amino acid
  misc_feature (19737)..(19737): Xaa can be any naturally occurring amino acid
  misc_feature (19739)..(19740): Xaa can be any naturally occurring amino acid
  misc_feature (19758)..(19758): Xaa can be any naturally occurring amino acid
  misc_feature (19760)..(19760): Xaa can be any naturally occurring amino acid
  misc_feature (19763)..(19763): Xaa can be any naturally occurring amino acid
  misc_feature (19768)..(19768): Xaa can be any naturally occurring amino acid
  misc_feature (19780)..(19780): Xaa can be any naturally occurring amino acid
  misc_feature (19783)..(19784): Xaa can be any naturally occurring amino acid
  misc_feature (19788)..(19788): Xaa can be any naturally occurring amino acid
  misc_feature (19791)..(19792): Xaa can be any naturally occurring amino acid
  misc_feature (19794)..(19797): Xaa can be any naturally occurring amino acid
  misc_feature (19800)..(19801): Xaa can be any naturally occurring amino acid
  misc_feature (19808)..(19808): Xaa can be any naturally occurring amino acid
  misc_feature (19815)..(19815): Xaa can be any naturally occurring amino acid
  misc_feature (19818)..(19819): Xaa can be any naturally occurring amino acid
  misc_feature (19821)..(19821): Xaa can be any naturally occurring amino acid
  misc_feature (19827)..(19827): Xaa can be any naturally occurring amino acid
  misc_feature (19831)..(19831): Xaa can be any naturally occurring amino acid
  misc_feature (19963)..(19963): Xaa can be any naturally occurring amino acid
  misc_feature (19970)..(19970): Xaa can be any naturally occurring amino acid
  misc_feature (19973)..(19974): Xaa can be any naturally occurring amino acid
  misc_feature (19976)..(19976): Xaa can be any naturally occurring amino acid
  misc_feature (19982)..(19982): Xaa can be any naturally occurring amino acid
  misc_feature (19986)..(19986): Xaa can be any naturally occurring amino acid
  misc_feature (19994)..(20001): Xaa can be any naturally occurring amino acid
  misc_feature (20009)..(20009): Xaa can be any naturally occurring amino acid
  misc_feature (20011)..(20011): Xaa can be any naturally occurring amino acid
  misc_feature (20013)..(20013): Xaa can be any naturally occurring amino acid
  misc_feature (20019)..(20021): Xaa can be any naturally occurring amino acid
  misc_feature (20023)..(20024): Xaa can be any naturally occurring amino acid
  misc_feature (20026)..(20028): Xaa can be any naturally occurring amino acid
  misc_feature (20032)..(20032): Xaa can be any naturally occurring amino acid
  misc_feature (20044)..(20044): Xaa can be any naturally occurring amino acid
  misc_feature (20048)..(20048): Xaa can be any naturally occurring amino acid
  misc_feature (20050)..(20051): Xaa can be any naturally occurring amino acid
  misc_feature (20069)..(20069): Xaa can be any naturally occurring amino acid
  misc_feature (20071)..(20071): Xaa can be any naturally occurring amino acid
  misc_feature (20074)..(20074): Xaa can be any naturally occurring amino acid
  misc_feature (20079)..(20079): Xaa can be any naturally occurring amino acid
  misc_feature (20091)..(20091): Xaa can be any naturally occurring amino acid
  misc_feature (20094)..(20095): Xaa can be any naturally occurring amino acid
  misc_feature (20099)..(20099): Xaa can be any naturally occurring amino acid
  misc_feature (20102)..(20103): Xaa can be any naturally occurring amino acid
  misc_feature (20105)..(20108): Xaa can be any naturally occurring amino acid
  misc_feature (20111)..(20112): Xaa can be any naturally occurring amino acid
  misc_feature (20119)..(20119): Xaa can be any naturally occurring amino acid
  misc_feature (20126)..(20126): Xaa can be any naturally occurring amino acid
  misc_feature (20129)..(20130): Xaa can be any naturally occurring amino acid
  misc_feature (20132)..(20132): Xaa can be any naturally occurring amino acid
  misc_feature (20138)..(20138): Xaa can be any naturally occurring amino acid
  misc_feature (20142)..(20142): Xaa can be any naturally occurring amino acid
  misc_feature (20275)..(20275): Xaa can be any naturally occurring amino acid
  misc_feature (20282)..(20282): Xaa can be any naturally occurring amino acid
  misc_feature (20285)..(20286): Xaa can be any naturally occurring amino acid
  misc_feature (20288)..(20288): Xaa can be any naturally occurring amino acid
  misc_feature (20294)..(20294): Xaa can be any naturally occurring amino acid
  misc_feature (20298)..(20298): Xaa can be any naturally occurring amino acid
  misc_feature (20306)..(20313): Xaa can be any naturally occurring amino acid
  misc_feature (20321)..(20321): Xaa can be any naturally occurring amino acid
  misc_feature (20323)..(20323): Xaa can be any naturally occurring amino acid
  misc_feature (20325)..(20325): Xaa can be any naturally occurring amino acid
  misc_feature (20331)..(20333): Xaa can be any naturally occurring amino acid
  misc_feature (20335)..(20336): Xaa can be any naturally occurring amino acid
  misc_feature (20806)..(20808): Xaa can be any naturally occurring amino acid
  misc_feature (20812)..(20812): Xaa can be any naturally occurring amino acid
  misc_feature (20824)..(20824): Xaa can be any naturally occurring amino acid
  misc_feature (20828)..(20828): Xaa can be any naturally occurring amino acid
  misc_feature (20830)..(20831): Xaa can be any naturally occurring amino acid
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTINLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTDTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWASVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPSTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGTSPAGTSPGSPEVSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVPTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLKDPEYAGHKLGIWDDFIPKFGKAAHMRELPLLSPPQDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGHRTEITSYKRISSSFLAQSMRSSDSPSEAITRLSNFPAMTESGGMILAMQTSPPGATSISAPTLDTSATASWTGTPLATTQRFTYSEKTTLFSKGREDTSQPSPPCVEETSSSSSVVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVTWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSPNVTTSTMEDTTISRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVISSSKISTPDHDKSTVPPDTFTGEIPRVFTSSIKTKSAEMTITTQASPPESASHSTLPLDTSTTLSQGGTHSTVSQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTASTLGDTSVSTSTPNISQTNQIQTEPTASLSPRLRESSTSEKTSSTTETNTAFSYVPTGAITQASRTEISSSRTSISDLDRSTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPEPVTSSPPNLSSPTQERLTTYKDTAHTEAMHASMHTNTAVANVGTSISGHESQSSVPADSHTSKATSPMGITFAMGDTSVYTSTPAFFETRIQSESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAMANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSLAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHVILTTDEDTTAIEAMHPSTSTAATNVETTCSGHGSQSSVLTDSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSFGHESPSSALADSETSKATSPMFITSTQEDTTVAISTPHFLETSRIQKESISSLSPKLRETGSSVETSSAIETSAVLSEVSIGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSPLTPGQVKTTEVLDASAEPETSSPPSLSSTSVEILATSEVTTDTEKIHPFPNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDTSTRTVSWFSTSPVMTESAEITMNTHTSPLGATTQGTSTLDTSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLTPGLVITTDRMGISREPGTSSTSNLSSTSHERLTTLEDTVDTEAMQPSTHTAVTNVRTSISGHESQSSVLSDSETPKATSSMGTTYTMGETSVSISTSDFFETSRVQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSALPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISTEVITRLSTSPIKAESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILATTEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLATSKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMSSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRTHIPDSDQSTMSPDIITEVITRLSSSSMMSESTQMTITTQKSSPGATAQSTLTLATTTAPLARTHSTVPPRFLHSEMTTLMSRSPENPSWKSSPFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSTPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASRQMASTILTEMMITTPYVFPDVPETTSSLATSLGAETSTALPRTTPSVLNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTAAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLDREQLYWELSQLTNGIKELGPYTLDRNSLYVNGFTHWIPVPTSSTPGTSTVDLGSGTPSSLPSPTAAGPLLVPFTLNFTITNLQYEEDMHHPGSRKFNTTERVLQGLLGPMFKNTSVGLLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMRHPGSRKFNTTERVLQGLLKPLFKSTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTLLRPEKHEAATGVDTICTHRVDPIGPGLDRERLYWELSQLTNSITELGPYTLDRDSLYVNGFNPRSSVPTTSTPGTSTVHLATSGTPSSLPGHTAPVPLLIPFTLNFTITNLHYEENMQHPGSRKFNTTERVLQGLLKPLFKNTSVGPLYSGCRLTLLRPEKHEAATGVDTICTHRVDPIGPGLDREXLYWELSXLTXXIXELGPYXLDRXSLYVNGFXXXXXXXXTSTPGTSXVXLXTSGTPXXXPXXTSAGPLLVPFTLNFTITNLQYEEDMHHPGSRKFNTTERVLQGLLGPMFKNTSVGLLYSGCRLTLLRPEKNGAATGMDAICSHRLDPKSPGLDREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQSSMTTTRTPDTSTMHLATSRTPASLSGPTTASPLLVLFTINCTITNLQYEEDMRRTGSRKFNTMESVLQGLLKPLFKNTSVGPLYSGCRLTLLRPKKDGAATGVDAICTHRLDPKSPGLNREQLYWELSKLTNDIEELGPYTLDRNSLYVNGFTHQSSVSTTSTPGTSTVDLRTSGTPSSLSSPTIMXXXPLLXPFTLNFTITNLXYEEXMXXPGSRKFNTTERVLQGLLRPLFKNTSVSSLYSGCRLTLLRPEKDGAATRVDAACTYRPDPKSPGLDREQLYWELSQLTHSITELGPYTLDRVSLYVNGFNPRSSVPTTSTPGTSTVHLATSGTPSSLPGHTXXXPLLXPFTLNFTITNLXYEEXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSFLTTSTPWTSTVDLGTSGTPSPVPSPTTAGPLLVPFTLNFTITNLQYEEDMHRPGSRRFNTTERVLQGLLTPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFSTTERVLQGLLKPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNQRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRTSVPTTSTPGTSTVDLGTSGTPFSLPSPAXXXPLLXPFTLNFTITNLXYEEXMXXPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSLPSSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTSLRSEKDGAATGVDAICTHRVDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICTHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLIPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTTSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETTGTPSSFPGHTEPGPLLIPFTFNFTITNLRYEENMQHPGSRKFNTTERVLQGLLTPLFKNTSVGPLYSGCRLTLLRPEKQEAATGVDTICTHRVDPIGPGLDRERLYWELSQLTNSITELGPYTLDRDSLYVDGFNPWSSVPTTSTPGTSTVHLATSGTPSPLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSITELGPYTLDRDSLYVNGFNPWSSVPTTSTPGTSTVHLATSGTPSSLPGHTTAGPLLVPFTLNFTITNLKYEEDMHCPGSRKFNTTERVLQSLHGPMFKNTSVGPLYSGCRLTLLRSEKDGAATGVDAICTHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTNSITELGPYTLDRDSLYVNGFTHRSSMPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFHPRSSVPTTSTPGTSTVHLATSGTPSSLPGHTAPVPLLIPFTLNFTITNLHYEENMQHPGSRKFNTTERVLQGLLGPMFKNTSVGLLYSGCRLTLLRPEKNGAATGMDAICSHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHQNSVPTTSTPGTSTVYWATTGTPSSFPGHTEPGPLLIPFTFNFTITNLHYEENMQHPGSRKFNTTERVLQGLLTPLFKNTSVGPLYSGCRLTLLRPEKQEAATGVDTICTHRVDPIGPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHRSSVPTTSSPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTLRLDPTGPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHRTSVPTTSTPGTSTVHLATSGTPSSLPGHTAPVPLLIPFTLNFTITNLQYEEDMHRPGSRKFNTTERVLQGLLSPIFKNSSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHWSSGLTTSTPWTSTVDLGTSGTPSPVPSPTTAGPLLVPFTLNFTITNLQYEEDMHRPGSRKFNATERVLQGLLSPIFKNTSVGPLYSGCRLTLLRPEKQEAATGVDTICTHRVDPIGPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHRSFGLTTSTPWTSTVDLGTSGTPSPVPSPTTAGPLLVPFTLNFTITNLQYEEDMHRPGSRKFNTTERVLQGLLTPLFRNTSVSSLYSGCRLTLLRPEKDGAATRVDAVCTHRPDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHWIPVPTSSTPGTSTVDLGSGTPSSLPSPTTAGPLLVPFTLNFTITNLQYGEDMGHPGSRKFNTTERVLQGLLGPIFKNTSVGPLYSGCRLTSLRSEKDGAATGVDAICIHHLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHQTFAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATRVDAVCTHRPDPKSPGLDREXLYWELSXLTXXIXELGPYXLDRXSLYVNGFXXXXXXXXTSTPGTSXVXLXTSGTPXXXPXXTAPVPLLIPFTLNFTITNLHYEENMQHPGSRKFNTTERVLQGLLRPLFKSTSVGPLYSGCRLTLLRPEKHGAATGVDAICTLRLDPTGPGLDRERLYWELSQLTNSVTELGPYTLDRDSLYVNGFTQRSSVPTTSIPGTSAVHLETSGTPASLPGHTAPGPLLVPFTLNFTITNLQYEVDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTXXXPLLXPFTLNFTITNLXYEEXMXXPGSRKFNTTERVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYNVGFTQRSSVPTTSVPGTPTVDLGTSGTPVSKPGPSAASPLLVLFTLNGTITNLRYEENMQHPGSRKFNTTERVLQGLLRSLFKSTSVGPLYSGCRLTLLRPEKDGTATGVDAICTHHPDPKSPRLDREQLYWELSQLTHNITELGHYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGSRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMKHLLSPLFQRSSLGARYTGCRVIALRSVKNGAETRVDLLCTYLQPLSGPGLPIKQVFHELSQQTHGITRLGPYSLDKDSLYLNGYNEPGLDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

We claim:

1. A purified monoclonal antibody that selectively binds to an amino acid sequence of CA125 (SEQ ID NO: 315), wherein the antibody selectively binds to an antigenic fragment of residues 1-8942 or an antigenic fragment of residues 9150-10,427 of SEQ ID NO: 310.

* * * * *